US011008585B2

(12) United States Patent
Barry et al.

(10) Patent No.: US 11,008,585 B2
(45) Date of Patent: May 18, 2021

(54) INSECTICIDAL PROTEINS AND METHODS FOR THEIR USE

(71) Applicants: E. I. DU PONT DE NEMOURS AND COMPANY, Wilmington, DE (US); PIONEER HI-BRED INTERNATIONAL, INC., Johnston, IA (US)

(72) Inventors: Jennifer Kara Barry, Ames, IA (US); Christian Bartholomay, Madison, WI (US); Louisa D'Lima, San Francisco, CA (US); James J. English, San Ramon, CA (US); Kevin Robert Hayes, Urbandale, IA (US); Lu Liu, Palo Alto, CA (US); Amy Lum, Hayward, CA (US); Brad Poland, Monroe, IA (US); Eric Jude Schepers, Port Deposit, MD (US); Weiping Xie, East Palo Alto, CA (US); Nasser Yalpani, Kelowna (CA); Genhai Zhu, San Jose, CA (US)

(73) Assignees: PIONEER HI-BRED INTERNATIONAL, INC.; E.I. DU PONT DE NEMOURS AND COMPANY

( * ) Notice: Subject to any disclaimer, the term of this patent is extended or adjusted under 35 U.S.C. 154(b) by 0 days.

(21) Appl. No.: 16/098,452

(22) PCT Filed: May 2, 2017

(86) PCT No.: PCT/US2017/030602
§ 371 (c)(1),
(2) Date: Nov. 2, 2018

(87) PCT Pub. No.: WO2017/192560
PCT Pub. Date: Nov. 9, 2017

(65) Prior Publication Data
US 2019/0136258 A1    May 9, 2019

Related U.S. Application Data

(60) Provisional application No. 62/331,708, filed on May 4, 2016.

(51) Int. Cl.
*C12N 15/82* (2006.01)
*C07K 14/21* (2006.01)
*A01N 63/27* (2020.01)
*A01N 63/50* (2020.01)

(52) U.S. Cl.
CPC .......... *C12N 15/8286* (2013.01); *C07K 14/21* (2013.01); *Y02A 40/146* (2018.01)

(58) Field of Classification Search
None
See application file for complete search history.

(56) References Cited

U.S. PATENT DOCUMENTS

| 2011/0023184 A1 | 1/2011 | Desai et al. |
| 2014/0007292 A1 | 1/2014 | Cerf et al. |
| 2014/0046049 A1 | 2/2014 | Desai et al. |
| 2014/0274885 A1 | 9/2014 | Cong et al. |

FOREIGN PATENT DOCUMENTS

| WO | WO 2015/023846 | * | 2/2015 |
| WO | 2015/038734 A2 | | 3/2015 |
| WO | 2018/140859 A2 | | 8/2018 |

OTHER PUBLICATIONS

GenBank CAN02457, 2015, https://www.ncbi.nlm.nih.gov/protein/CAN02457.*
Tabashnik et al, 2013, Nature Biotechnol. 31:510-521.*
Preston, 2004, Phil. Trans. R. Soc. Lond. B 359:907-918.*
GenBank Accession WP_019961352, Jun. 30, 2013.
UNIPROTKB/TREMBL Accession No. A5CTM8, Dec. 9, 2015, http://www.uniprot.org/uniprot/a5ctm8.txt?version=40.
UNIPROTKB/TREMBL Accession No. A8GEE9, Dec. 9, 2015, http://www.uniprot.org/uniprot/A8GEE9.txt?version=36.
UNIPROTKB/TREMBL Accession No. A0A0F4QUD9, Dec. 9, 2015, http://www.uniprot.org/uniprot/A0A0F4QUD9.txt?version=4.
International Search Report and Written Opinion for International Application No. PCT/US17/30602, dated Oct. 2, 2017.
Kupferschmied, Peter; et al. "Promise for plant pest control: root-associated pseudomonads with insecticidal activities," Frontiers in Plant Science, Jul. 31, 2013 (Jul. 31, 2013), vol. 4, Article 287, pp. 1-17.
Rosado, Carlos J.; et al.: "The MACPF/CDC family of pore-forming toxins," Cellular Microbiology, Jul. 10, 2008 (Jul. 10, 2008), vol. 10, No. 9, pp. 1765-1774.

* cited by examiner

*Primary Examiner* — Anne Kubelik

(57) ABSTRACT

Compositions and methods for controlling pests are provided. The methods involve transforming organisms with a nucleic acid sequence encoding an insecticidal protein. In particular, the nucleic acid sequences are useful for preparing plants and microorganisms that possess insecticidal activity. Thus, transformed bacteria, plants, plant cells, plant tissues and seeds are provided. Compositions are insecticidal nucleic acids and proteins of bacterial species. The sequences find use in the construction of expression vectors for subsequent transformation into organisms of interest including plants, as probes for the isolation of other homologous (or partially homologous) genes. The pesticidal proteins find use in controlling, inhibiting growth or killing Lepidopteran, Coleopteran, Dipteran, fungal, Hemipteran and nematode pest populations and for producing compositions with insecticidal activity.

5 Claims, 7 Drawing Sheets

Figure 2:
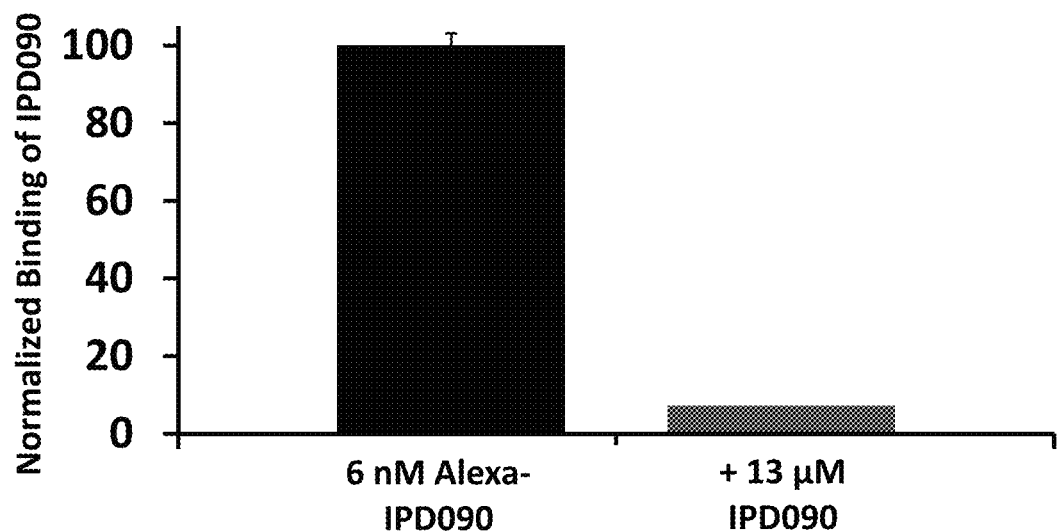

Specification includes a Sequence Listing.

Fig. 1A

```
                    1                                                          50
IPD090Ca    (1)    MEHVDLPTGLVKFSSNHHLQLLRDTADLSESVLPGVEAIGLYNPFLGYA
IPD090Aa    (1)    MENIDLPQGLVNFST-QHLQLIRFKAGLNETVLPGVEAIGLYNPFISYA 51                                                         100
IPD090Ca    (51)   GVCSGTVQLFDWNNAKKKVSFKPEFVVPEIVDVQQNDSASYTNISGNTV
IPD090Aa    (50)   SVNSGAVQLFDWATAKKREVPFKAGYFVPEIVDVQQNDSATYTNVSGNTI 101                                                        150
                                                                        ▼
IPD090Ca    (101)  TEYQRSLAVSVAIEGKYNFFSGSLSTDYDENSLRNAENEFTRIQQSINLW
IPD090Aa    (100)  SEYQRSLATSVAIEGRYNFFSGSLSTDFDSNSLRNAENEFTRIQQSINLW
                                                                        ▲

151                                                        200
IPD090Ca    (151)  SLRLPSVKSLRDLMLPHMREQLDELDVKNPSAISRFFDRVGSHFLTGIVM
IPD090Aa    (150)  SLRLPSVKSLRELMLPHMRQQLDELNVNDPKAISRYFDRVGSHFLTGIVM 201                                                        250
                                                              ▼
IPD090Ca    (201)  GGRAILAASTNKLKVKRDYSVSVIAKASYEGLTGQLSAEARTKYGESMSS
IPD090Aa    (200)  GGRAILASSTNKLRVKRDYSVSVVAKASYEGLTGQLSAEAKAKYGESISS
                                                              ▲

251                                                        300
                                                                         ▼
IPD090Ca    (251)  FTQYSSTHQEVRGGDGTKAHGVFEG-KAGFQAWVDSVGTSPDFVDFVPTI
IPD090Aa    (250)  FTQYSNTHQEVRGGDGAKAHGVFSGKKEDFQAWVDSVSASPDFVDFVPTI
                                                                         ▲

301                                                        350
                                                                         ▼
IPD090Ca    (300)  PMLEIWSLCKTDSQAEAMKRHFDTVWAREQSDKYRIKANYIDQLVVITGD
IPD090Aa    (300)  PMQEIWTLCSSEAQAEAMRKHYDDVWAPAQSEKYRVKANYIDQLVVITGG
                                                                         ▲

351                                                        400
                                                       ▼
IPD090Ca    (350)  SSTIEPPAGYTKIPYDLNAGAKGDFIYLCYHEQAWYPDNTKPAVTAIKII
IPD090Aa    (350)  SSTIEPPVGYSKIEYDLNAGAGGDFIYLCYHEQTWQADRPKDAVTDIRII
                                                       ▲
```

Fig. 1B

```
              401                                                            450
                                        ▼                                 ▼
IPD090Ca (400) YDREPVPTGYIKLPQDLNKGAGGADIYLCYKLEGYNTDTAINKITVISGN
IPD090Aa (400) FNKEPTPPGYTKLPQDLNKGAGGDDVFLCYKTEAYNTDTAINKVTVIGGN
                                        ▲                                 ▲

451                       484
IPD090Ca (450) NPDINAPYGYEKVPGDLNKGAKGNFIYACTFVGK
IPD090Aa (450) NADINAPYGYLKVPGDLNRGAGGNFIYACTFVGK
```

INSECTICIDAL PROTEINS AND METHODS FOR THEIR USE

CROSS-REFERENCE TO RELATED APPLICATIONS

This Application claims the benefit of U.S. Provisional Application No. 62/331,708, filed on May 4, 2016, which is incorporated herein by reference in its entirety.

REFERENCE TO SEQUENCE LISTING SUBMITTED ELECTRONICALLY

The official copy of the sequence listing is submitted electronically via EFS-Web as an ASCII formatted sequence listing with a file named "6441WOPCT_Sequence_Listing" created on May 1, 2017, and having a size of 1,094 kilobytes and is filed concurrently with the specification. The sequence listing contained in this ASCII formatted document is part of the specification and is herein incorporated by reference in its entirety.

FIELD

This disclosure relates to the field of molecular biology. Provided are novel genes that encode pesticidal proteins. These pesticidal proteins and the nucleic acid sequences that encode them are useful in preparing pesticidal formulations and in the production of transgenic pest-resistant plants.

BACKGROUND

Biological control of insect pests of agricultural significance using a microbial agent, such as fungi, bacteria or another species of insect affords an environmentally friendly and commercially attractive alternative to synthetic chemical pesticides. Generally speaking, the use of biopesticides presents a lower risk of pollution and environmental hazards and biopesticides provide greater target specificity than is characteristic of traditional broad-spectrum chemical insecticides. In addition, biopesticides often cost less to produce and thus improve economic yield for a wide variety of crops.

Certain species of microorganisms of the genus *Bacillus* are known to possess pesticidal activity against a range of insect pests including Lepidoptera, Diptera, Coleoptera, Hemiptera and others. *Bacillus thuringiensis* (Bt) and *Bacillus popilliae* are among the most successful biocontrol agents discovered to date. Insect pathogenicity has also been attributed to strains of *B. larvae*, *B. lentimorbus*, *B. sphaericus* and *B. cereus*. Microbial insecticides, particularly those obtained from *Bacillus* strains, have played an important role in agriculture as alternatives to chemical pest control.

Crop plants have been developed with enhanced insect resistance by genetically engineering crop plants to produce pesticidal proteins from *Bacillus*. For example, corn and cotton plants have been genetically engineered to produce pesticidal proteins isolated from strains of *Bacillus thuringiensis*. These genetically engineered crops are now widely used in agriculture and have provided the farmer with an environmentally friendly alternative to traditional insect-control methods. While they have proven to be very successful commercially, these genetically engineered, insect-resistant crop plants provide resistance to only a narrow range of the economically important insect pests. In some cases, insects can develop resistance to different insecticidal compounds, which raises the need to identify alternative biological control agents for pest control.

Accordingly, there remains a need for new pesticidal proteins with different ranges of insecticidal activity against insect pests, e.g., insecticidal proteins which are active against a variety of insects in the order Lepidoptera and the order Coleoptera including but not limited to insect pests that have developed resistance to existing insecticides.

SUMMARY

In one aspect compositions and methods for conferring pesticidal activity to bacteria, plants, plant cells, tissues and seeds are provided. Compositions include nucleic acid molecules encoding sequences for pesticidal and insecticidal polypeptides, vectors comprising those nucleic acid molecules, and host cells comprising the vectors. Compositions also include the pesticidal polypeptide sequences and antibodies to those polypeptides. Compositions also comprise transformed bacteria, plants, plant cells, tissues and seeds.

In another aspect isolated or recombinant nucleic acid molecules are provided encoding IPD090 polypeptides including amino acid substitutions, deletions, insertions, and fragments thereof. Provided are isolated or recombinant nucleic acid molecules capable of encoding IPD090 polypeptides of SEQ ID NO: 2, SEQ ID NO: 4, SEQ ID NO: 6, SEQ ID NO: 379 or SEQ ID NO: 384, as well as amino acid substitutions, deletions, insertions, fragments thereof, and combinations thereof. Nucleic acid sequences that are complementary to a nucleic acid sequence of the embodiments or that hybridize to a sequence of the embodiments are also encompassed. The nucleic acid sequences can be used in DNA constructs or expression cassettes for transformation and expression in organisms, including microorganisms and plants. The nucleotide or amino acid sequences may be synthetic sequences that have been designed for expression in an organism including, but not limited to, a microorganism or a plant.

In another aspect IPD090 polypeptides are encompassed. Also provided are isolated or recombinant IPD090 polypeptides of SEQ ID NO: 2, SEQ ID NO: 4, SEQ ID NO: 6, SEQ ID NO: 379, and SEQ ID NO: 384, as well as amino acid substitutions, deletions, insertions, fragments thereof and combinations thereof.

In another aspect, methods are provided for producing the polypeptides and for using those polypeptides for controlling or killing a Lepidopteran, Coleopteran, nematode, fungi, and/or Dipteran pests. The transgenic plants of the embodiments express one or more of the pesticidal sequences disclosed herein. In various embodiments, the transgenic plant further comprises one or more additional genes for insect resistance, for example, one or more additional genes for controlling Coleopteran, Lepidopteran, Hemipteran or nematode pests. It will be understood by one of skill in the art that the transgenic plant may comprise any gene imparting an agronomic trait of interest.

In another aspect, methods for detecting the nucleic acids and polypeptides of the embodiments in a sample are also included. A kit for detecting the presence of an IPD090 polypeptide or detecting the presence of a polynucleotide encoding an IPD090 polypeptide in a sample is provided. The kit may be provided along with all reagents and control samples necessary for carrying out a method for detecting the intended agent, as well as instructions for use.

In another aspect the compositions and methods of the embodiments are useful for the production of organisms with enhanced pest resistance or tolerance. These organisms and compositions comprising the organisms are desirable for agricultural purposes. The compositions of the embodiments are also useful for generating altered or improved proteins that have pesticidal activity or for detecting the presence of IPD090 polypeptides.

BRIEF DESCRIPTION OF THE FIGURES

FIG. 1A-1B shows an amino acid sequence alignment, using the ALIGNX® module of the Vector NTI® suite, of the IPD090Aa polypeptide (SEQ ID NO: 2) and the IPD090Ca polypeptide (SEQ ID NO: 6). The amino acid sequence diversity between the amino acid sequences is highlighted. Conservative amino acid differences are indicated by (A) shading and non-conservative amino acid difference by (A) shading. The N-terminal amino acids deleted compared to the IPD090Aa polypeptide (SEQ ID NO: 2) in the truncation variant, IPD090Aa (TR1) polypeptide (SEQ ID NO: 10) of Example 6, are underlined in the IPD090Aa sequence (SEQ ID NO: 2). The respective boundary points of the IPD090Aa/IPD090Ca chimera proteins of Example 11 are indicated below the IPD090Aa sequence (SEQ ID NO: 2) by a "▲" above the IPD090Ca sequence (SEQ ID NO: 6) by a "▼".

FIG. 2 shows a bar chart reflecting densitometry values of in-gel fluorescence, from the SDS-PAGE gel of Example 14, for homologous competition of 6.3 nM IPD090Aa$^{Alexa}$ binding to WCRW BBMVs normalized to the binding signal in the absence of unlabeled protein ("6 nM Alexa-IPD090") and in the presence of a saturating concentration of unlabeled protein ("+13 μM IPD090"). The difference in magnitude between the bars reflects specific binding.

FIG. 3 shows the corn rootworm node injury score (CRWNIS) Score of individual transgenic T0 maize events from constructs PHP73234 and PHP73237 expressing the IPD090 polypeptide of SEQ ID NO: 377, and PHP77372 expressing the IPD090 polypeptide of SEQ ID NO: 10.

FIG. 4 shows the structure of IPD090Aa (SEQ ID NO: 2), as determined by X-ray Crystallography, indicating the MACPF domain of the N-terminal region and a 3-prism domain of the C-terminal domain region. A Mg+ atom is shown as a sphere at the bottom of the β-prism domain. The two clusters of helices are labeled as CH1 and CH2.

FIG. 5 shows a 90-degree rotation of the IPD090Aa polypeptide (SEQ ID NO: 2) about the vertical axis showing the N-terminal β-strand for a 5th member of the central β-sheet.

FIG. 6 shows a close up view of the C-terminal β-prism domain of the IPD090Aa (SEQ ID NO: 2) structure illustrating the 3-fold axis and Mg+2 interactions.

FIG. 7 shows the Ramachadran Plot for refined IPD090Aa (SEQ ID NO: 2) 2.1 Å structure.

DETAILED DESCRIPTION

It is to be understood that this disclosure is not limited to the particular methodology, protocols, cell lines, genera, and reagents described, as such may vary. It is also to be understood that the terminology used herein is for the purpose of describing particular embodiments only, and is not intended to limit the scope of the present disclosure.

As used herein the singular forms "a", "and", and "the" include plural referents unless the context clearly dictates otherwise. Thus, for example, reference to "a cell" includes a plurality of such cells and reference to "the protein" includes reference to one or more proteins and equivalents thereof known to those skilled in the art, and so forth. All technical and scientific terms used herein have the same meaning as commonly understood to one of ordinary skill in the art to which this disclosure belongs unless clearly indicated otherwise.

The present disclosure is drawn to compositions and methods for controlling pests. The methods involve transforming organisms with nucleic acid sequences encoding IPD090 polypeptides. In particular, the nucleic acid sequences of the embodiments are useful for preparing plants and microorganisms that possess pesticidal activity. Thus, transformed bacteria, plants, plant cells, plant tissues and seeds are provided. The compositions include pesticidal nucleic acids and proteins of bacterial species. The nucleic acid sequences find use in the construction of expression vectors for subsequent transformation into organisms of interest, as probes for the isolation of other homologous (or partially homologous) genes, and for the generation of altered IPD090 polypeptides by methods known in the art, such as site directed mutagenesis, domain swapping or DNA shuffling. The IPD090 polypeptides find use in controlling or killing Lepidopteran, Coleopteran, Dipteran, fungal, Hemipteran and nematode pest populations and for producing compositions with pesticidal activity. Insect pests of interest include, but are not limited to, *Lepidoptera* species including but not limited to: Corn Earworm, (CEW) (*Helicoverpa zea*), European Corn Borer (ECB) (*Ostrinia nubialis*), diamond-back moth, e.g., *Helicoverpa zea* Boddie; soybean looper, e.g., *Pseudoplusia includens* Walker; and velvet bean caterpillar e.g., *Anticarsia gemmatalis* Hübner and *Coleoptera* species including but not limited to Western corn rootworm (*Diabrotica virgifera*)—WCRW, Southern corn rootworm (*Diabrotica undecimpunctata howardi*)—SCRW, and Northern corn rootworm (*Diabrotica barberi*)—NCRW.

By "pesticidal toxin" or "pesticidal protein" is used herein to refer to a toxin that has toxic activity against one or more pests, including, but not limited to, members of the *Lepidoptera*, Diptera, Hemiptera and Coleoptera orders or the Nematoda phylum or a protein that has homology to such a protein. Pesticidal proteins have been isolated from organisms including, for example, *Bacillus* sp., *Pseudomonas* sp., *Photorhabdus* sp., *Xenorhabdus* sp., *Clostridium bifermentans* and *Paenibacillus popilliae*. Pesticidal proteins include but are not limited to: insecticidal proteins from *Pseudomonas* sp. such as PSEEN3174 (Monalysin; (2011) *PLoS Pathogens* 7:1-13); from *Pseudomonas protegens* strain CHA0 and Pf-5 (previously *fluorescens*) (Pechy-Tarr, (2008) *Environmental Microbiology* 10:2368-2386; GenBank Accession No. EU400157); from *Pseudomonas taiwanensis* (Liu, et al., (2010) *J. Agric. Food Chem.,* 58:12343-12349) and from *Pseudomonas pseudoalcaligenes* (Zhang, et al., (2009) *Annals of Microbiology* 59:45-50 and Li, et al., (2007) *Plant Cell Tiss. Organ Cult.* 89:159-168); insecticidal proteins from *Photorhabdus* sp. and *Xenorhabdus* sp. (Hinchliffe, et al., (2010) *The Open Toxicology Journal,* 3:101-118 and Morgan, et al., (2001) *Applied and Envir. Micro.* 67:2062-2069); U.S. Pat. Nos. 6,048,838, and 6,379,946; a PIP-1 polypeptide of US Patent Publication US20140007292; an AfIP-1A and/or AfIP-1B polypeptide of U.S. Pat. No. 9,475,847; a PHI-4 polypeptide of US Patent Publication US20140274885 and US20160040184; a PIP-47 polypeptide of US Publication Number US20160186204, a PIP-72 polypeptide of US Patent Publication Number US20160366891; a PtIP-50 polypeptide and a PtIP-65 polypeptide of PCT Publication Number WO2015/120270; a PtIP-83 polypeptide of PCT Publication Number WO2015/120276; a PtIP-96 polypeptide of PCT Serial Number PCT/US15/55502; an IPD079 polypeptide of PCT Publication Number WO2017/23486; an IPD082 polypeptide of Serial Number PCT/US16/65531, an IPD093 polypeptide of U.S. Ser. No. 62/434,020; an IPD080 polypeptide of U.S. Ser. No. U.S. 62/411,318; and δ-endotoxins including, but not limited to, the Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry28, Cry29, Cry30, Cry31, Cry32, Cry33, Cry34, Cry35, Cry36, Cry37, Cry38, Cry39, Cry40, Cry41, Cry42, Cry43, Cry44, Cry45, Cry46, Cry47, Cry49, Cry50, Cry51, Cry52, Cry53, Cry54, Cry55, Cry56, Cry57, Cry58, Cry59, Cry60, Cry61, Cry62, Cry63, Cry64, Cry65, Cry66, Cry67, Cry68, Cry69, Cry70, Cry71, and Cry72 classes of δ-endotoxin genes and the *B. thuringiensis* cytolytic cyt1 and cyt2 genes. Members of these classes of *B. thuringiensis* insecticidal proteins well known to one skilled in the art (see, Crickmore, et al., "*Bacillus thuringiensis* toxin nomenclature" (2011), at lifesci.sussex.ac.uk/home/Neil_Crickmore/Bt/ which can be accessed on the world-wide web using the "www" prefix).

Examples of δ-endotoxins also include but are not limited to Cry1A proteins of U.S. Pat. Nos. 5,880,275 and 7,858,849; a Cry1Ac mutant of U.S. Pat. No. 9,512,187; a DIG-3 or DIG-11 toxin (N-terminal deletion of α-helix 1 and/or α-helix 2 variants of cry proteins such as Cry1A, Cry3A) of U.S. Pat. Nos. 8,304,604, 8,304,605 and 8,476,226; Cry1B of U.S. patent application Ser. No. 10/525,318, US Patent Application Publication Number US20160194364, and U.S. Pat. Nos. 9,404,121 and 8,772,577; Cry1B variants of PCT Publication Number WO2016/61197 and Serial Number PCT/US17/27160; Cry1C of U.S. Pat. No. 6,033,874; Cry1F of U.S. Pat. Nos. 5,188,960 and 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein including but not limited to an engineered hybrid insecticidal protein (eHIP) created by fusing unique combinations of variable regions and conserved blocks of at least two different Cry proteins (US Patent Application Publication Number 2010/0017914); a Cry4 protein; a Cry5 protein; a Cry6 protein; Cry8 proteins of U.S. Pat. Nos. 7,329,736, 7,449,552, 7,803,943, 7,476,781, 7,105,332, 7,339,092, 7,378,499, 7,462,760, and 9,593,345; a Cry9 protein such as such as members of the Cry9A, Cry9B, Cry9C, Cry9D, Cry9E and Cry9F families including the Cry9 protein of U.S. Pat. Nos. 9,000,261 and 8,802,933, and U.S. Ser. No. 62/287,281; a Cry15 protein of Naimov, et al., (2008) *Applied and Environmental Microbiology,* 74:7145-7151; a Cry14 protein of U.S. Pat. No. 8,933,299; a Cry22, a Cry34Ab1 protein of U.S. Pat. Nos. 6,127,180, 6,624,145 and 6,340,593; a truncated Cry34 protein of U.S. Pat. No. 8,816,157; a CryET33 and cryET34 protein of U.S. Pat. Nos. 6,248,535, 6,326,351, 6,399,330, 6,949,626, 7,385,107 and 7,504,229; a CryET33 and CryET34 homologs of US Patent Publication Number 2006/0191034, 2012/0278954, and PCT Publication Number WO 2012/139004; a Cry35Ab1 protein of U.S. Pat. Nos. 6,083,499, 6,548,291 and 6,340,593; a Cry46 protein of U.S. Pat. No. 9,403,881, a Cry51 protein, a Cry binary toxin; a TIC901 or related toxin; TIC807 of US Patent Application Publication Number 2008/0295207; TIC853 of US Patent U.S. Pat. No. 8,513,493; ET29, ET37, TIC809, TIC810, TIC812, TIC127, TIC128 of PCT US 2006/033867; engineered Hemipteran toxic proteins of US Patent Application Publication Number US20160150795, AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020 and AXMI-021 of WO 2006/083891; AXMI-010 of WO 2005/038032; AXMI-003 of WO 2005/021585; AXMI-008 of US Patent Application Publication Number 2004/0250311; AXMI-006 of US Patent Application Publication Number 2004/0216186; AXMI-007 of US Patent Application Publication Number 2004/0210965; AXMI-009 of US Patent Application Number 2004/0210964; AXMI-014 of US Patent Application Publication Number 2004/0197917; AXMI-004 of US Patent Application Publication Number 2004/0197916; AXMI-028 and AXMI-029 of WO 2006/119457; AXMI-007, AXMI-008, AXMI-0080rf2, AXMI-009, AXMI-014 and AXMI-004 of WO 2004/074462; AXMI-150 of U.S. Pat. No. 8,084,416; AXMI-205 of US Patent Application Publication Number 2011/0023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063 and AXMI-064 of US Patent Application Publication Number 2011/0263488; AXMI046, AXMI048, AXMI050, AXMI051, AXMI052, AXMI053, AXMI054, AXMI055, AXMI056, AXMI057, AXMI058, AXMI059, AXMI060, AXMI061, AXMI067, AXMI069, AXMI071, AXMI072, AXMI073, AXMI074, AXMI075, AXMI087, AXMI088, AXMI093, AXMI070, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI125, AXMI126, AXMI127, AXMI129, AXMI151, AXMI161, AXMI164, AXMI183, AXMI132, AXMI137, AXMI138 of US Patent U.S. Pat. Nos. 8,461,421 and 8,461,422; AXMI-R1 and related proteins of US Patent Application Publication Number 2010/0197592; AXMI221Z, AXMI222z, AXMI223z, AXMI224z and AXMI225z of WO 2011/103248; AXMI218, AXMI219, AXMI220, AXMI226, AXMI227, AXMI228, AXMI229, AXMI230 and AXMI231 of WO 2011/103247; AXMI-115, AXMI-113, AXMI-005, AXMI-163 and AXMI-184 of U.S. Pat. No. 8,334,431; AXMI-001, AXMI-002, AXMI-030, AXMI-035 and AXMI-045 of US Patent Application Publication Number 2010/0298211; AXMI-066 and AXMI-076 of US Patent Application Publication Number 2009/0144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, dsAXMI111, AXMI112, AXMI114, AXMI116, AXMI117, AXMI118, AXMI119, AXMI120, AXMI121, AXMI122, AXMI123, AXMI124, AXMI1257, AXMI1268, AXMI127, AXMI129, AXMI164, AXMI151, AXMI161, AXMI183, AXMI132, AXMI138, AXMI137 of US Patent U.S. Pat. No. 8,461,421; AXMI192 of US Patent U.S. Pat. No. 8,461,415; AXMI281 of US Patent Application Publication Number US20160177332; AXMI422 of U.S. Pat. No. 8,252,872; cry proteins such as Cry1A and Cry3A having modified proteolytic sites of U.S.

Pat. No. 8,319,019; a Cry1Ac, Cry2Aa and Cry1Ca toxin protein from *Bacillus thuringiensis* strain VBTS 2528 of US Patent Application Publication Number 2011/0064710. The Cry proteins MP032, MP049, MP051, MP066, MP068, MP070, MP091S, MP109S, MP114, MP121, MP134S, MP183S, MP185S, MP186S, MP195S, MP197S, MP208S, MP209S, MP212S, MP214S, MP217S, MP222S, MP234S, MP235S, MP237S, MP242S, MP243, MP248, MP249S, MP251M, MP252S, MP253, MP259S, MP287S, MP288S, MP295S, MP296S, MP297S, MP300S, MP304S, MP306S, MP310S, MP312S, MP314S, MP319S, MP325S, MP326S, MP327S, MP328S, MP334S, MP337S, MP342S, MP349S, MP356S, MP359S, MP360S, MP437S, MP451S, MP452S, MP466S, MP468S, MP476S, MP482S, MP522S, MP529S, MP548S, MP552S, MP562S, MP564S, MP566S, MP567S, MP569S, MP573S, MP574S, MP575S, MP581S, MP590, MP594S, MP596S, MP597, MP599S, MP600S, MP601S, MP602S, MP604S, MP626S, MP629S, MP630S, MP631S, MP632S, MP633S, MP634S, MP635S, MP639S, MP640S, MP644S, MP649S, MP651S, MP652S, MP653S, MP661S, MP666S, MP672S, MP696S, MP704S, MP724S, MP729S, MP739S, MP755S, MP773S, MP799S, MP800S, MP801S, MP802S, MP803S, MP805S, MP809S, MP815S, MP828S, MP831S, MP844S, MP852, MP865S, MP879S, MP887S, MP891S, MP896S, MP898S, MP935S, MP968, MP989, MP993, MP997, MP1049, MP1066, MP1067, MP1080, MP1081, MP1200, MP1206, MP1233, and MP1311 of U.S. Ser. No. 62/429,426. The insecticidal activity of Cry proteins is well known to one skilled in the art (for review, see, van Frannkenhuyzen, (2009) *J. Invert. Path.* 101:1-16). The use of Cry proteins as transgenic plant traits is well known to one skilled in the art and Cry-transgenic plants including but not limited to plants expressing Cry1Ac, Cry1Ac+ Cry2Ab, Cry1Ab, Cry1A.105, Cry1F, Cry1Fa2, Cry1F+ Cry1Ac, Cry2Ab, Cry3A, mCry3A, Cry3Bb1, Cry34Ab1, Cry35Ab1, Vip3A, mCry3A, Cry9c and CBI-Bt have received regulatory approval (see, Sanahuja, (2011) *Plant Biotech Journal* 9:283-300 and the CERA. (2010) GM Crop Database Center for Environmental Risk Assessment (CERA), ILSI Research Foundation, Washington D.C. at cera-gmc.org/index.php?action=gm_crop_database which can be accessed on the world-wide web using the "www" prefix). More than one pesticidal proteins well known to one skilled in the art can also be expressed in plants such as Vip3Ab & Cry1Fa (US2012/0317682); Cry1BE & Cry1F (US2012/0311746); Cry1CA & Cry1AB (US2012/0311745); Cry1F & CryCa (US2012/0317681); Cry1 DA & Cry1BE (US2012/0331590); Cry1 DA & Cry1Fa (US2012/0331589); Cry1AB & Cry1BE (US2012/0324606); Cry1Fa & Cry2Aa and Cry1I & Cry1E (US2012/0324605); Cry34Ab/35Ab and Cry6Aa (US20130167269); Cry34Ab/VCry35Ab & Cry3Aa (US20130167268); and Cry3A and Cry1Ab or Vip3Aa (U.S. Pat. No. 9,045,766). Pesticidal proteins also include insecticidal lipases including lipid acyl hydrolases of U.S. Pat. No. 7,491,869, and cholesterol oxidases such as from *Streptomyces* (Purcell et al. (1993) *Biochem Biophys Res Commun* 15:1406-1413). Pesticidal proteins also include VIP (vegetative insecticidal proteins) toxins of U.S. Pat. Nos. 5,877,012, 6,107,279 6,137,033, 7,244,820, 7,615,686, and 8,237,020 and the like. Other VIP proteins are well known to one skilled in the art (see, lifesci.sussex.ac.uk/home/Neil_Crickmore/Bt/vip.html which can be accessed on the world-wide web using the "www" prefix). Pesticidal proteins also include toxin complex (TC) proteins, obtainable from organisms such as *Xenorhabdus*, *Photorhabdus* and *Paenibacillus* (see, U.S. Pat. Nos. 7,491,698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus*, *Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but not limited to lycotoxin-1 peptides and mutants thereof (U.S. Pat. No. 8,334,366).

In some embodiments the IPD090 polypeptide includes an amino acid sequence deduced from the full-length nucleic acid sequence disclosed herein and amino acid sequences that are shorter than the full-length sequences, either due to the use of an alternate downstream start site or due to processing that produces a shorter protein having pesticidal activity. Processing may occur in the organism the protein is expressed in or in the pest after ingestion of the protein.

Thus, provided herein are novel isolated or recombinant nucleic acid sequences that confer pesticidal activity. Also provided are the amino acid sequences of IPD090 polypeptides. The protein resulting from translation of these IPD090 genes allows cells to control or kill pests that ingest it.

IPD090 Proteins and Variants and Fragments Thereof

IPD090 polypeptides are encompassed by the disclosure. "IPD090 polypeptide", and "IPD090 protein" as used herein interchangeably refers to a polypeptide having insecticidal activity including but not limited to insecticidal activity against one or more insect pests of the Lepidoptera and/or Coleoptera orders, and is sufficiently homologous to the IPD090Aa polypeptide of SEQ ID NO: 2. A variety of IPD090 polypeptides are contemplated. Sources of IPD090 polypeptides or related proteins include bacterial species selected from but not limited to *Pseudomonas* species and *Woodsholea* species. Alignment of the amino acid sequences of IPD090 polypeptide homologs (for example—FIG. 1), allows for the identification of residues that are highly conserved amongst the natural homologs of this family.

"Sufficiently homologous" is used herein to refer to an amino acid sequence that has at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence homology compared to a reference sequence using one of the alignment programs described herein using standard parameters. In some embodiments the sequence homology is against the full length sequence of an IPD090 polypeptide. In some embodiments the IPD090 polypeptide has at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 2, SEQ ID NO: 4, SEQ ID NO: 6, SEQ ID NO: 379 or SEQ ID NO: 384. The term "about" when used herein in context with percent sequence identity means+/−0.5%. One of skill in the art will recognize that these values can be appropriately adjusted to determine corresponding homology of proteins taking into account amino acid similarity and the like. In some embodiments the sequence identity is calculated using ClustalW algorithm in the ALIGNX® module of the Vector NTI® Program Suite (Invitrogen Corporation, Carlsbad, Calif.) with all default parameters. In some embodiments the sequence identity is across the entire length of polypeptide calculated using ClustalW algorithm in the ALIGNX® module of the Vector NTI® Program Suite (Invitrogen Corporation, Carlsbad, Calif.) with all default parameters.

As used herein, the terms "protein," "peptide molecule," or "polypeptide" includes any molecule that comprises five or more amino acids. It is well known in the art that protein, peptide or polypeptide molecules may undergo modification, including post-translational modifications, such as, but not limited to, disulfide bond formation, glycosylation, phosphorylation or oligomerization. Thus, as used herein, the terms "protein," "peptide molecule" or "polypeptide" includes any protein that is modified by any biological or non-biological process. The terms "amino acid" and "amino acids" refer to all naturally occurring L-amino acids.

A "recombinant protein" is used herein to refer to a protein that is no longer in its natural environment, for example in vitro or in a recombinant bacterial or plant host cell. An IPD090 polypeptide that is substantially free of cellular material includes preparations of protein having less than about 30%, 20%, 10% or 5% (by dry weight) of non-pesticidal protein (also referred to herein as a "contaminating protein").

"Fragments" or "biologically active portions" include polypeptide fragments comprising amino acid sequences sufficiently identical to an IPD090 polypeptide and that exhibit insecticidal activity. "Fragments" or "biologically active portions" of IPD090 polypeptides includes fragments comprising amino acid sequences sufficiently identical to the amino acid sequence set forth in SEQ ID NO: 2, SEQ ID NO: 4, SEQ ID NO: 6, SEQ ID NO: 379 or SEQ ID NO: 384 wherein the IPD090 polypeptide has insecticidal activity. Such biologically active portions can be prepared by recombinant techniques and evaluated for insecticidal activity. In some embodiments, the IPD090 polypeptide fragment is an N-terminal and/or a C-terminal truncation of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31 or more amino acids from the N-terminus and/or C-terminus relative to SEQ ID NO: 2, SEQ ID NO: 4 or SEQ ID NO: 6, SEQ ID NO: 379 or SEQ ID NO: 384, e.g., by proteolysis, by insertion of a start codon, by deletion of the codons encoding the deleted amino acids and concomitant insertion of a start codon, and/or insertion of a stop codon. In some embodiments, the IPD090 polypeptide fragment is an N-terminal truncation of at least 1, 2, 3, 4, 5, 6, 7, 8, 9, 10, 11, 12, 13, 14, 15, 16, 17, 18, 19, 20, 21, 22, 23, 24 amino acids from the N-terminus of SEQ ID NO: 2, SEQ ID NO: 4, SEQ ID NO: 6, SEQ ID NO: 379 or SEQ ID NO: 384. In some embodiments, the IPD090 polypeptide fragment is an N-terminal and/or a C-terminal truncation of at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34 or more amino acids from the N-terminus and/or C-terminus relative to SEQ ID NO: 2, SEQ ID NO: 4 or SEQ ID NO: 6, SEQ ID NO: 379 or SEQ ID NO: 384. In some embodiments, the IPD090 polypeptide fragment comprises amino acids 1-315, amino acids 1-330, amino acids 1-349, amino acids 1-450, amino acids 25-315, amino acids 25-330, amino acids 25-349, amino acids 25-450 or amino acids 25-483 of any of SEQ ID NO: 2, SEQ ID NO: 4, SEQ ID NO: 6, SEQ ID NO: 379 or SEQ ID NO: 384. In some embodiments the truncated variant is the polypeptide of SEQ ID NO: 10.

"Variants" as used herein refers to proteins or polypeptides having an amino acid sequence that is at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater identical to the parental amino acid sequence.

In some embodiments an IPD090 polypeptide comprises an amino acid sequence having at least about 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity to the amino acid sequence of SEQ ID NO: 2, SEQ ID NO: 4, SEQ ID NO: 6, SEQ ID NO: 379 or SEQ ID NO: 384, wherein the IPD090 polypeptide has insecticidal activity.

In some embodiments an IPD090 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 2, SEQ ID NO: 4, SEQ ID NO: 6, SEQ ID NO: 379 or SEQ ID NO: 384.

In some embodiments the sequence identity is across the entire length of the polypeptide calculated using ClustalW algorithm in the ALIGNX® module of the Vector NTI® Program Suite (Invitrogen Corporation, Carlsbad, Calif.) with all default parameters.

In some embodiments the IPD090 polypeptide comprises an amino acid sequence having at least about 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 2.

In some embodiments an IPD090 polypeptide comprises an amino acid sequence of SEQ ID NO: 2, SEQ ID NO: 4, SEQ ID NO: 6, SEQ ID NO: 379 or SEQ ID NO: 384 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95 or more amino acid substitutions compared to the native amino acid at the corresponding position of SEQ ID NO: 2, SEQ ID NO: 4, SEQ ID NO: 6, SEQ ID NO: 379 or SEQ ID NO: 384.

In some embodiments an IPD090 polypeptide variant comprises any one or more amino acid substitutions corresponding to positions 3, 4, 8, 12, 15, 16, 21, 23, 24, 26, 28, 30, 38, 46, 47, 50, 52, 55, 62, 63, 67, 68, 70, 73, 74, 75, 76, 80, 90, 91, 94, 99, 100, 108, 115, 127, 129, 161, 169, 175, 177, 178, 180, 185, 207, 213, 223, 240, 241, 247, 255, 266, 273, 275, 277, 278, 287, 288, 302, 306, 309, 310, 311, 312, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 391, 392, 395, 397, 400, 401, 402, 405, 407, 410, 423, 425, 426, 431, 433, 434, 437, 438, 439, 440, 441, 442, 443, 444, 445, 446, 447, 448, 449, 450, 451, 452, 453, 454, 455, 457, 458, 459, 460, 468, and 471 of SEQ ID NO: 2, in any combination.

In some embodiments an IPD090 polypeptide variant comprises any one or more active amino acid substitutions of Table 10 and/or 12.

Methods for such manipulations are generally known in the art. For example, amino acid sequence variants of an IPD090 polypeptide can be prepared by mutations in the DNA. This may also be accomplished by one of several forms of mutagenesis and/or in directed evolution. In some aspects, the changes encoded in the amino acid sequence will not substantially affect the function of the protein. Such variants will possess the desired pesticidal activity. However, it is understood that the ability of an IPD090 polypeptide to confer pesticidal activity may be improved by the use of such techniques upon the compositions of this disclosure.

For example, conservative amino acid substitutions may be made at one or more predicted nonessential amino acid residues. A "nonessential" amino acid residue is a residue that can be altered from the wild-type sequence of an IPD090 polypeptide without altering the biological activity. Nonessential amino acid residues can be identified by aligning related IPD090 homologs such as is shown in FIG. 1. A "conservative amino acid substitution" is one in which the amino acid residue is replaced with an amino acid residue having a similar side chain. Families of amino acid residues having similar side chains have been defined in the art. These families include: amino acids with basic side chains (e.g., lysine, arginine, histidine); acidic side chains (e.g., aspartic acid, glutamic acid); polar, negatively charged residues and their amides (e.g., aspartic acid, asparagine, glutamic, acid, glutamine; uncharged polar side chains (e.g., glycine, asparagine, glutamine, serine, threonine, tyrosine, cysteine); small aliphatic, nonpolar or slightly polar residues (e.g., Alanine, serine, threonine, proline, glycine); nonpolar side chains (e.g., alanine, valine, leucine, isoleucine, proline, phenylalanine, methionine, tryptophan); large aliphatic, nonpolar residues (e.g., methionine, leucine, isoleucine, valine, cystine); beta-branched side chains (e.g., threonine, valine, isoleucine); aromatic side chains (e.g., tyrosine, phenylalanine, tryptophan, histidine); large aromatic side chains (e.g., tyrosine, phenylalanine, tryptophan).

Amino acid substitutions may be made in nonconserved regions that retain function. In general, such substitutions would not be made for conserved amino acid residues or for amino acid residues residing within a conserved motif, where such residues are essential for protein activity. Examples of residues that are conserved and that may be essential for protein activity include, for example, residues that are identical between all proteins contained in an alignment of similar or related toxins to the sequences of the embodiments (e.g., residues that are identical in an alignment of homologous proteins). Examples of residues that are conserved but that may allow conservative amino acid substitutions and still retain activity include, for example, residues that have only conservative substitutions between all proteins contained in an alignment of similar or related toxins to the sequences of the embodiments (e.g., residues that have only conservative substitutions between all proteins contained in the alignment homologous proteins). However, one of skill in the art would understand that functional variants may have minor conserved or nonconserved alterations in the conserved residues. Guidance as to appropriate amino acid substitutions that do not affect biological activity of the protein of interest may be found in the model of Dayhoff, et al., (1978) *Atlas of Protein Sequence and Structure* (Natl. Biomed. Res. Found., Washington, D.C.), herein incorporated by reference.

In making such changes, the hydropathic index of amino acids may be considered. The importance of the hydropathic amino acid index in conferring interactive biologic function on a protein is generally understood in the art (Kyte and Doolittle, (1982) *J Mol Biol.* 157(1):105-32). It is accepted that the relative hydropathic character of the amino acid contributes to the secondary structure of the resultant protein, which in turn defines the interaction of the protein with other molecules, for example, enzymes, substrates, receptors, DNA, antibodies, antigens, and the like.

It is known in the art that certain amino acids may be substituted by other amino acids having a similar hydropathic index or score and still result in a protein with similar biological activity, i.e., still obtain a biological functionally equivalent protein. Each amino acid has been assigned a hydropathic index on the basis of its hydrophobicity and charge characteristics (Kyte and Doolittle, ibid). These are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9) and arginine (−4.5). In making such changes, the substitution of amino acids whose hydropathic indices are within +2 is preferred, those which are within +1 are particularly preferred, and those within +0.5 are even more particularly preferred.

It is also understood in the art that the substitution of like amino acids can be made effectively on the basis of hydrophilicity. U.S. Pat. No. 4,554,101, states that the greatest local average hydrophilicity of a protein, as governed by the hydrophilicity of its adjacent amino acids, correlates with a biological property of the protein.

As detailed in U.S. Pat. No. 4,554,101, the following hydrophilicity values have been assigned to amino acid residues: arginine (+3.0); lysine (+3.0); aspartate (+3.0.+0.1); glutamate (+3.0.+0.1); serine (+0.3); asparagine (+0.2); glutamine (+0.2); glycine (0); threonine (−0.4); proline (−0.5.+0.1); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4).

Alternatively, alterations may be made to the protein sequence of many proteins at the amino or carboxy terminus without substantially affecting activity. This can include insertions, deletions or alterations introduced by modern molecular methods, such as PCR, including PCR amplifications that alter or extend the protein coding sequence by virtue of inclusion of amino acid encoding sequences in the oligonucleotides utilized in the PCR amplification. Alternatively, the protein sequences added can include entire protein-coding sequences, such as those used commonly in the art to generate protein fusions. Such fusion proteins are often used to (1) increase expression of a protein of interest (2) introduce a binding domain, enzymatic activity or epitope to facilitate either protein purification, protein detection or other experimental uses known in the art (3) target secretion or translation of a protein to a subcellular organelle, such as the periplasmic space of Gram-negative bacteria, mitochondria or chloroplasts of plants or the endoplasmic reticulum of eukaryotic cells, the latter of which often results in glycosylation of the protein.

Variant nucleotide and amino acid sequences of the disclosure also encompass sequences derived from mutagenic and recombinogenic procedures such as DNA shuffling.

With such a procedure, one or more different IPD090 polypeptide coding regions can be used to create a new IPD090 polypeptide possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between a pesticidal gene and other known pesticidal genes to obtain a new gene coding for a protein with an improved property of interest, such as an increased insecticidal activity. Strategies for such DNA shuffling are known in the art. See, for example, Stemmer, (1994) *Proc. Natl. Acad. Sci. USA* 91:10747-10751; Stemmer, (1994) *Nature* 370:389-391; Crameri, et al., (1997) *Nature Biotech.* 15:436-438; Moore, et al., (1997) *J. Mol. Biol.* 272:336-347; Zhang, et al., (1997) *Proc. Natl. Acad. Sci. USA* 94:4504-4509; Crameri, et al., (1998) *Nature* 391:288-291; and U.S. Pat. Nos. 5,605,793 and 5,837,458.

Domain swapping or shuffling is another mechanism for generating altered IPD090 polypeptides. Domains may be swapped between IPD090 polypeptides resulting in hybrid or chimeric toxins with improved insecticidal activity or target spectrum. Methods for generating recombinant proteins and testing them for pesticidal activity are well known in the art (see, for example, Naimov, et al., (2001) *Appl. Environ. Microbiol.* 67:5328-5330; de Maagd, et al., (1996) *Appl. Environ. Microbiol.* 62:1537-1543; Ge, et al., (1991) *J. Biol. Chem.* 266:17954-17958; Schnepf, et al., (1990) *J. Biol. Chem.* 265:20923-20930; Rang, et al., 91999) *Appl. Environ. Microbiol.* 65:2918-2925).

Phylogenetic, sequence motif, and structural analyses of insecticidal protein families. A sequence and structure analysis method can be employed, which is composed of four components: phylogenetic tree construction, protein sequence motifs finding, secondary structure prediction, and alignment of protein sequences and secondary structures. Details about each component are illustrated below.

1) Phylogenetic Tree Construction

The phylogenetic analysis can be performed using the software MEGA5. Protein sequences can be subjected to ClustalW version 2 analysis (Larkin M. A et al (2007) *Bioinformatics* 23(21): 2947-2948) for multiple sequence alignment. The evolutionary history is then inferred by the Maximum Likelihood method based on the JTT matrix-based model. The tree with the highest log likelihood is obtained, exported in Newick format, and further processed to extract the sequence IDs in the same order as they appeared in the tree. A few clades representing sub-families can be manually identified for each insecticidal protein family.

2) Protein Sequence Motifs Finding

Protein sequences are re-ordered according to the phylogenetic tree built previously, and fed to the MOTIF analysis tool MEME (Multiple EM for MOTIF Elicitation) (Bailey T. L., and Elkan C., *Proceedings of the Second International Conference on Intelligent Systems for Molecular Biology*, pp. 28-36, AAAI Press, Menlo Park, Calif., 1994) for identification of key sequence motifs. MEME is setup as follows: Minimum number of sites 2, Minimum motif width 5, and Maximum number of motifs 30. Sequence motifs unique to each sub-family were identified by visual observation. The distribution of MOTIFs across the entire gene family could be visualized in HTML webpage. The MOTIFs are numbered relative to the ranking of the E-value for each MOTIF.

3) Secondary Structure Prediction

PSIPRED, top ranked secondary structure prediction method (Jones D T. (1999) *J. Mol. Biol.* 292: 195-202), can be used for protein secondary structure prediction. The tool provides accurate structure prediction using two feed-forward neural networks based on the PSI-BLAST output. The PSI-BLAST database is created by removing low-complexity, transmembrane, and coiled-coil regions in Uniref100. The PSIPRED results contain the predicted secondary structures (Alpha helix: H, Beta strand: E, and Coil: C) and the corresponding confidence scores for each amino acid in a given protein sequence.

4) Alignment of Protein Sequences and Secondary Structures

A script can be developed to generate gapped secondary structure alignment according to the multiple protein sequence alignment from step 1 for all proteins. All aligned protein sequences and structures are concatenated into a single FASTA file, and then imported into MEGA for visualization and identification of conserved structures.

In some embodiments the IPD090 polypeptide has a modified physical property. As used herein, the term "physical property" refers to any parameter suitable for describing the physical-chemical characteristics of a protein. As used herein, "physical property of interest" and "property of interest" are used interchangeably to refer to physical properties of proteins that are being investigated and/or modified. Examples of physical properties include, but are not limited to, net surface charge and charge distribution on the protein surface, net hydrophobicity and hydrophobic residue distribution on the protein surface, surface charge density, surface hydrophobicity density, total count of surface ionizable groups, surface tension, protein size and its distribution in solution, melting temperature, heat capacity, and second virial coefficient. Examples of physical properties also include, IPD090 polypeptide having increased expression, increased solubility, decreased phytotoxicity, and digestibility of proteolytic fragments in an insect gut. Models for digestion by simulated gastric fluids are known to one skilled in the art (Fuchs, R. L. and J. D. Astwood. Food Technology 50: 83-88, 1996; Astwood, J. D., et al *Nature Biotechnology* 14: 1269-1273, 1996; Fu T J et al *J. Agric Food Chem.* 50: 7154-7160, 2002).

In some embodiments variants include polypeptides that differ in amino acid sequence due to mutagenesis. Variant proteins encompassed by the disclosure are biologically active, that is they continue to possess the desired biological activity (i.e. pesticidal activity) of the native protein. In some embodiment the variant will have at least about 10%, at least about 30%, at least about 50%, at least about 70%, at least about 80% or more of the insecticidal activity of the native protein. In some embodiments, the variants may have improved activity over the native protein.

Bacterial genes quite often possess multiple methionine initiation codons in proximity to the start of the open reading frame. Often, translation initiation at one or more of these start codons will lead to generation of a functional protein. These start codons can include ATG codons. However, bacteria such as *Bacillus* sp. also recognize the codon GTG as a start codon, and proteins that initiate translation at GTG codons contain a methionine at the first amino acid. On rare occasions, translation in bacterial systems can initiate at a TTG codon, though in this event the TTG encodes a methionine. Furthermore, it is not often determined a priori which of these codons are used naturally in the bacterium. Thus, it is understood that use of one of the alternate methionine codons may also lead to generation of pesticidal proteins. These pesticidal proteins are encompassed in the present disclosure and may be used in the methods of the present disclosure. It will be understood that, when expressed in plants, it will be necessary to alter the alternate start codon to ATG for proper translation.

In some embodiments the IPD090 polypeptide comprises the amino acid sequence of SEQ ID NO: 2, SEQ ID NO: 4, SEQ ID NO: 6, SEQ ID NO: 379 or SEQ ID NO: 384.

In some embodiments the IPD090 polypeptide comprises the amino acid sequence of SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 321, SEQ ID NO: 322, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 377, SEQ ID NO: 379, and SEQ ID NO: 384.

In some embodiments, chimeric IPD090 polypeptide are provided comprising an N-terminal Region of a first IPD090 polypeptide of the disclosure operably fused to a C-terminal Region of a second IPD090 polypeptide of the disclosure.

In some embodiments, chimeric IPD090 polypeptide are provided comprising an N-terminal Region of a first IPD090 polypeptide operably fused to a C-terminal Region of a second IPD090 polypeptide, where the first and second IPD090 polypeptide is selected from SEQ ID NO: 2, SEQ ID NO: 4, SEQ ID NO: 6, SEQ ID NO: 8, SEQ ID NO: 10, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID In some embodiments, chimeric polypeptides are provided comprising regions of at least two different IPD090 polypeptides of the disclosure.

In some embodiments, chimeric polypeptides are provided comprising regions of at least two different IPD090 polypeptides selected from SEQ ID NO: 2, SEQ ID NO: 4, SEQ ID NO: 6, SEQ ID NO: 8, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 321, SEQ ID NO: 322, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 377, SEQ ID NO: 379, and SEQ ID NO: 384.

In some embodiments the chimeric IPD090 polypeptide comprises: a) an N-terminal Region having at least 90% sequence identity to the amino acid residues corresponding to amino acids 1 to about 144, amino acids 1 to about 239, amino acids 1 to about 296, amino acids 1 to about 348, amino acids 1 to about 382, amino acids 1 to about 422, amino acids 1 to about 442 of SEQ ID NO: 2 or SEQ ID NO: 4; and b) a C-terminal Region having at least 90% sequence identity to the amino acid residues corresponding to amino acids of about 146 to about 483, amino acids of about 241 to about 483, amino acids of about 297 to about 483, amino acids of about 349 to about 483, amino acids of about 383 to about 483, amino acids of about 423 to about 483 or amino acids of about 443 to about 483 of SEQ ID NO: 6.

In some embodiments the chimeric IPD090 polypeptide comprises; a) an N-terminal Region having at least 90% sequence identity to the amino acid residues corresponding to amino acids 1 to about 144 of SEQ ID NO: 2 or SEQ ID NO: 4; and b) a C-terminal Region having at least 90% sequence identity to the amino acid residues corresponding to amino acids of about 146 to 483 of SEQ ID NO: 6.

In some embodiments the chimeric IPD090 polypeptide comprises; a) an N-terminal Region having at least 90% sequence identity to the amino acid residues corresponding to amino acids 1 to about 239 of SEQ ID NO: 2 or SEQ ID NO: 4; and b) a C-terminal Region having at least 90% sequence identity to the amino acid residues corresponding to amino acids of about 241 to 483 of SEQ ID NO: 6.

In some embodiments the chimeric IPD090 polypeptide comprises; a) an N-terminal Region having at least 90% sequence identity to the amino acid residues corresponding to amino acids 1 to about 296 of SEQ ID NO: 2 or SEQ ID NO: 4; and b) a C-terminal Region having at least 90% sequence identity to the amino acid residues corresponding to amino acids of about 297 to about 483 of SEQ ID NO: 6.

In some embodiments the chimeric IPD090 polypeptide comprises; a) an N-terminal Region having at least 90% sequence identity to the amino acid residues corresponding to amino acids 1 to about 348 of SEQ ID NO: 2 or SEQ ID NO: 4; and b) a C-terminal Region having at least 90% sequence identity to the amino acid residues corresponding to amino acids of about 349 to 483 of SEQ ID NO: 6.

In some embodiments the chimeric IPD090 polypeptide comprises; a) an N-terminal Region having at least 90% sequence identity to the amino acid residues corresponding to amino acids 1 to about 382 of SEQ ID NO: 2 or SEQ ID NO: 4; and b) a C-terminal Region having at least 90% sequence identity to the amino acid residues corresponding to amino acids of about 383 to 483 of SEQ ID NO: 6.

In some embodiments the chimeric IPD090 polypeptide comprises; a) an N-terminal Region having at least 90% sequence identity to the amino acid residues corresponding to amino acids 1 to about 422 of SEQ ID NO: 2 or SEQ ID NO: 4; and b) a C-terminal Region having at least 90% sequence identity to the amino acid residues corresponding to amino acids about 423 to 483 of SEQ ID NO: 6.

In some embodiments the chimeric IPD090 polypeptide comprises; a) an N-terminal Region having at least 90% sequence identity to the amino acid residues corresponding to amino acids 1 to about 442 of SEQ ID NO: 2 or SEQ ID NO: 4; and b) a C-terminal Region having at least 90% sequence identity to the amino acid residues corresponding to amino acids about 443 to 483 of SEQ ID NO: 6.

In some embodiments the chimeric IPD090 polypeptide comprises; a) an N-terminal Region comprising amino acids 1 to about 144, amino acids 1 to about 239, amino acids 1 to about 296, amino acids 1 to about 348, amino acids 1 to about 382, amino acids 1 to about 422, amino acids 1 to about 442 of SEQ ID NO: 2, SEQ ID NO: 4 or SEQ ID NO: 6; and b) a C-terminal Region comprising the amino acids of about 146 to about 483, amino acids of about 241 to about 483, amino acids of about 297 to about 483, amino acids of about 349 to about 483, amino acids of about 383 to about 483, amino acids of about 423 to about 483 or amino acids of about 443 to about 483 of SEQ ID NO: 2, SEQ ID NO: 4 or SEQ ID NO: 6.

In some embodiments the chimeric IPD090 polypeptide comprises; a) an N-terminal Region comprising amino acids 1 to about 144 of SEQ ID NO: 2 or SEQ ID NO: 4; and b) a C-terminal Region comprising amino acids of about 146 to 483 of SEQ ID NO: 6.

In some embodiments the chimeric IPD090 polypeptide comprises; a) an N-terminal Region comprising amino acids 1 to about 239 of SEQ ID NO: 2 or SEQ ID NO: 4; and b) a C-terminal Region comprising amino acids of about 241 to 483 of SEQ ID NO: 6.

In some embodiments the chimeric IPD090 polypeptide comprises; a) an N-terminal Region comprising amino acids 1 to about 296 of SEQ ID NO: 2 or SEQ ID NO: 4; and b) a C-terminal Region comprising amino acids of about 297 to about 483 of SEQ ID NO: 6.

In some embodiments the chimeric IPD090 polypeptide comprises; a) an N-terminal Region comprises amino acids 1 to about 348 of SEQ ID NO: 2 or SEQ ID NO: 4; and b) a C-terminal Region comprising amino acids of about 349 to 483 of SEQ ID NO: 6.

In some embodiments the chimeric IPD090 polypeptide comprises; a) an N-terminal Region comprising amino acids 1 to about 382 of SEQ ID NO: 2 or SEQ ID NO: 4; and b) a C-terminal Region comprising amino acids of about 383 to 483 of SEQ ID NO: 6.

In some embodiments the chimeric IPD090 polypeptide comprises; a) an N-terminal Region comprising amino acids 1 to about 422 of SEQ ID NO: 2 or SEQ ID NO: 4; and b) a C-terminal Region comprising amino acids about 423 to 483 of SEQ ID NO: 6.

In some embodiments the chimeric IPD090 polypeptide comprises; a) an N-terminal Region comprising amino acids 1 to about 442 of SEQ ID NO: 2 or SEQ ID NO: 4; and b) a C-terminal Region comprising amino acids about 443 to 483 of SEQ ID NO: 6.

In other embodiments the IPD090 polypeptide may be expressed as a precursor protein with an intervening sequence that catalyzes multi-step, post translational protein splicing. Protein splicing involves the excision of an intervening sequence from a polypeptide with the concomitant joining of the flanking sequences to yield a new polypeptide (Chong, et al., (1996) *J. Biol. Chem.*, 271:22159-22168). This intervening sequence or protein splicing element, referred to as inteins, which catalyze their own excision through three coordinated reactions at the N-terminal and C-terminal splice junctions: an acyl rearrangement of the N-terminal cysteine or serine; a transesterfication reaction between the two termini to form a branched ester or thioester intermediate and peptide bond cleavage coupled to cyclization of the intein C-terminal asparagine to free the intein (Evans, et al., (2000) *J. Biol. Chem.*, 275:9091-9094. The elucidation of the mechanism of protein splicing has led to a number of intein-based applications (Comb, et al., U.S. Pat. No. 5,496,714; Comb, et al., U.S. Pat. No. 5,834,247; Camarero and Muir, (1999) *J. Amer. Chem. Soc.* 121:5597-5598; Chong, et al., (1997) *Gene* 192:271-281, Chong, et al., (1998) *Nucleic Acids Res.* 26:5109-5115; Chong, et al., (1998) *J. Biol. Chem.* 273:10567-10577; Cotton, et al., (1999) *J. Am. Chem. Soc.* 121:1100-1101; Evans, et al., (1999) *J. Biol. Chem.* 274:18359-18363; Evans, et al., (1999) *J. Biol. Chem.* 274:3923-3926; Evans, et al., (1998) *Protein Sci.* 7:2256-2264; Evans, et al., (2000) *J. Biol. Chem.* 275:9091-9094; Iwai and Pluckthun, (1999) *FEBS Lett.* 459:166-172; Mathys, et al., (1999) *Gene* 231:1-13; Mills, et al., (1998) *Proc. Natl. Acad. Sci. USA* 95:3543-3548; Muir, et al., (1998) *Proc. Natl. Acad. Sci. USA* 95:6705-6710; Otomo, et al., (1999) *Biochemistry* 38:16040-16044; Otomo, et al., (1999) *J. Biolmol. NMR* 14:105-114; Scott, et al., (1999) *Proc. Natl. Acad. Sci. USA* 96:13638-13643; Severinov and Muir, (1998) *J. Biol. Chem.* 273:16205-16209; Shingledecker, et al., (1998) *Gene* 207: 187-195; Southworth, et al., (1998) *EMBO J.* 17:918-926; Southworth, et al., (1999) *Biotechniques* 27:110-120; Wood, et al., (1999) *Nat. Biotechnol.* 17:889-892; Wu, et al., (1998a) *Proc. Natl. Acad. Sci. USA* 95:9226-9231; Wu, et al., (1998b) *Biochim Biophys Acta* 1387:422-432; Xu, et al., (1999) *Proc. Natl. Acad. Sci. USA* 96:388-393; Yamazaki, et al., (1998) *J. Am. Chem. Soc.*, 120:5591-5592). For the application of inteins in plant transgenes, see, Yang, et al., (*Transgene Res* 15:583-593 (2006)) and Evans, et al., (*Annu. Rev. Plant Biol.* 56:375-392 (2005)).

In another embodiment the IPD090 polypeptide may be encoded by two separate genes where the intein of the precursor protein comes from the two genes, referred to as a split-intein, and the two portions of the precursor are joined by a peptide bond formation. This peptide bond formation is accomplished by intein-mediated trans-splicing. For this purpose, a first and a second expression cassette comprising the two separate genes further code for inteins capable of mediating protein trans-splicing. By trans-splicing, the proteins and polypeptides encoded by the first and second fragments may be linked by peptide bond formation. Trans-splicing inteins may be selected from the nucleolar and organellar genomes of different organisms including eukaryotes, archaebacteria and eubacteria. Inteins that may be used for are listed at neb.com/neb/inteins.html, which can be accessed on the world-wide web using the "www" prefix). The nucleotide sequence coding for an intein may be split into a 5' and a 3' part that code for the 5' and the 3' part of the intein, respectively. Sequence portions not necessary for intein splicing (e.g. homing endonuclease domain) may be deleted. The intein coding sequence is split such that the 5' and the 3' parts are capable of trans-splicing. For selecting a suitable splitting site of the intein coding sequence, the considerations published by Southworth, et al., (1998) *EMBO J.* 17:918-926 may be followed. In constructing the first and the second expression cassette, the 5' intein coding sequence is linked to the 3' end of the first fragment coding for the N-terminal part of the IPD090 polypeptide and the 3' intein coding sequence is linked to the 5' end of the second fragment coding for the C-terminal part of the IPD090 polypeptide.

In general, the trans-splicing partners can be designed using any split intein, including any naturally-occurring or artificially-split split intein. Several naturally-occurring split inteins are known, for example: the split intein of the DnaE gene of *Synechocystis* sp. PCC6803 (see, Wu, et al., (1998) *Proc Natl Acad Sci USA.* 95(16):9226-31 and Evans, et al., (2000) *J Biol Chem.* 275(13):9091-4 and of the DnaE gene from *Nostoc punctiforme* (see, Iwai, et al., (2006) *FEBS Lett.* 580(7):1853-8). Non-split inteins have been artificially split in the laboratory to create new split inteins, for example: the artificially split Ssp DnaB intein (see, Wu, et al., (1998) *Biochim Biophys Acta.* 1387:422-32) and split Sce VMA intein (see, Brenzel, et al., (2006) *Biochemistry.* 45(6):1571-8) and an artificially split fungal mini-intein (see, Elleuche, et al., (2007) *Biochem Biophys Res Commun.* 355(3):830-4). There are also intein databases available that catalogue known inteins (see for example the online-database available at: bioinformatics.weizmann.ac.il/~pietro/inteins/Inteinstable.html, which can be accessed on the world-wide web using the "www" prefix).

Naturally-occurring non-split inteins may have endonuclease or other enzymatic activities that can typically be removed when designing an artificially-split split intein. Such mini-inteins or minimized split inteins are well known in the art and are typically less than 200 amino acid residues long (see, Wu, et al., (1998) *Biochim Biophys Acta.* 1387: 422-32). Suitable split inteins may have other purification enabling polypeptide elements added to their structure, provided that such elements do not inhibit the splicing of the split intein or are added in a manner that allows them to be removed prior to splicing. Protein splicing has been reported using proteins that comprise bacterial intein-like (BIL) domains (see, Amitai, et al., (2003) *Mol Microbiol.* 47:61-73) and hedgehog (Hog) auto-processing domains (the latter is combined with inteins when referred to as the Hog/intein superfamily or HINT family (see, Dassa, et al., (2004) *J Biol Chem.* 279:32001-7) and domains such as these may also be used to prepare artificially-split inteins. In particular, non-splicing members of such families may be modified by molecular biology methodologies to introduce or restore splicing activity in such related species. Recent studies demonstrate that splicing can be observed when a N-terminal split intein component is allowed to react with a C-terminal split intein component not found in nature to be its "partner"; for example, splicing has been observed utilizing partners that have as little as 30 to 50% homology with the "natural" splicing partner (see, Dassa, et al., (2007) *Biochemistry.* 46(1):322-30). Other such mixtures of disparate split intein partners have been shown to be unreactive one with another (see, Brenzel, et al., (2006) *Biochemistry.* 45(6):1571-8). However, it is within the ability of a person skilled in the relevant art to determine whether a particular pair of polypeptides is able to associate with each other to provide a functional intein, using routine methods and without the exercise of inventive skill.

In some embodiments the IPD090 polypeptide is a circular permuted variant. In certain embodiments the IPD090 polypeptide is a circular permuted variant of the polypeptide of, SEQ ID NO: 2, SEQ ID NO: 4, SEQ ID NO: 6, SEQ ID NO: 379 or SEQ ID NO: 384, or variant thereof having an amino acid substitution, deletion, addition or combinations thereof. The development of recombinant DNA methods has made it possible to study the effects of sequence transposition on protein folding, structure and function. The approach used in creating new sequences resembles that of naturally occurring pairs of proteins that are related by linear reorganization of their amino acid sequences (Cunningham, et al., (1979) *Proc. Natl. Acad. Sci. U.S.A.* 76:3218-3222; Teather and Erfle, (1990) *J. Bacteriol.* 172:3837-3841; Schimming, et al., (1992) *Eur. J. Biochem.* 204:13-19; Yamiuchi and Minamikawa, (1991) *FEBS Lett.* 260:127-130; MacGregor, et al., (1996) *FEBS Lett.* 378:263-266). The first in vitro application of this type of rearrangement to proteins was described by Goldenberg and Creighton (*J. Mol. Biol.* 165:407-413, 1983). In creating a circular permuted variant, a new N-terminus is selected at an internal site (breakpoint) of the original sequence, the new sequence having the same order of amino acids as the original from the breakpoint until it reaches an amino acid that is at or near the original C-terminus. At this point the new sequence is joined, either directly or through an additional portion of sequence (linker), to an amino acid that is at or near the original N-terminus and the new sequence continues with the same sequence as the original until it reaches a point that is at or near the amino acid that was N-terminal to the breakpoint site of the original sequence, this residue forming the new C-terminus of the chain. The length of the amino acid sequence of the linker can be selected empirically or with guidance from structural information or by using a combination of the two approaches. When no structural information is available, a small series of linkers can be prepared for testing using a design whose length is varied in order to span a range from 0 to 50 Å and whose sequence is chosen in order to be consistent with surface exposure (hydrophilicity, Hopp and Woods, (1983) *Mol. Immunol.* 20:483-489; Kyte and Doolittle, (1982) *J. Mol. Biol.* 157:105-132; solvent exposed surface area, Lee and Richards, (1971) *J. Mol. Biol.* 55:379-400) and the ability to adopt the necessary conformation without deranging the configuration of the pesticidal polypeptide (conformationally flexible; Karplus and Schulz, (1985) *Naturwissenschaften* 72:212-213). Assuming an average of translation of 2.0 to 3.8 Å per residue, this would mean the length to test would be between 0 to 30 residues, with 0 to 15 residues being the preferred range. Exemplary of such an empirical series would be to construct linkers using a cassette sequence such as Gly-Gly-Gly-Ser repeated n times, where n is 1, 2, 3 or 4. Those skilled in the art will recognize that there are many such sequences that vary in length or composition that can serve as linkers with the primary consideration being that they be neither excessively long nor short (cf., Sandhu, (1992) *Critical Rev. Biotech.* 12:437-462); if they are too long, entropy effects will likely destabilize the three-dimensional fold, and may also make folding kinetically impractical, and if they are too short, they will likely destabilize the molecule because of torsional or steric strain. Those skilled in the analysis of protein structural information will recognize that using the distance between the chain ends, defined as the distance between the c-alpha carbons, can be used to define the length of the sequence to be used or at least to limit the number of possibilities that must be tested in an empirical selection of linkers. They will also recognize that it is sometimes the case that the positions of the ends of the polypeptide chain are ill-defined in structural models derived from x-ray diffraction or nuclear magnetic resonance spectroscopy data, and that when true, this situation will therefore need to be taken into account in order to properly estimate the length of the linker required. From those residues whose positions are well defined are selected two residues that are close in sequence to the chain ends, and the distance between their c-alpha carbons is used to calculate an approximate length for a linker between them. Using the calculated length as a guide, linkers with a range of number of residues (calculated using 2 to 3.8 Å per residue) are then selected. These linkers may be composed of the original sequence, shortened or lengthened as necessary, and when lengthened the additional residues may be chosen to be flexible and hydrophilic as described above; or optionally the original sequence may be substituted for using a series of linkers, one example being the Gly-Gly-Gly-Ser cassette approach mentioned above; or optionally a combination of the original sequence and new sequence having the appropriate total length may be used. Sequences of pesticidal polypeptides capable of folding to biologically active states can be prepared by appropriate selection of the beginning (amino terminus) and ending (carboxyl terminus) positions from within the original polypeptide chain while using the linker sequence as described above. Amino and carboxyl termini are selected from within a common stretch of sequence, referred to as a breakpoint region, using the guidelines described below. A novel amino acid sequence is thus generated by selecting amino and carboxyl termini from within the same breakpoint region. In many cases the selection of the new termini will be such that the original position of the carboxyl terminus immediately preceded that of the amino terminus. However, those skilled in the art will recognize that selections of termini anywhere within the region may function, and that these will effectively lead to either deletions or additions to the amino or carboxyl portions of the new sequence. It is a central tenet of molecular biology that the primary amino acid sequence of a protein dictates folding to the three-dimensional structure necessary for expression of its biological function. Methods are known to those skilled in the art to obtain and interpret three-dimensional structural information using x-ray diffraction of single protein Crystals or nuclear magnetic resonance spectroscopy of protein solutions. Examples of structural information that are relevant to the identification of breakpoint regions include the location and type of protein secondary structure (alpha and 3-10 helices, parallel and anti-parallel beta sheets, chain reversals and turns, and loops; Kabsch and Sander, (1983) *Biopolymers* 22:2577-2637; the degree of solvent exposure of amino acid residues, the extent and type of interactions of residues with one another (Chothia, (1984) *Ann. Rev. Biochem.* 53:537-572) and the static and dynamic distribution of conformations along the polypeptide chain (Alber and Mathews, (1987) *Methods Enzymol.* 154:511-533). In some cases, additional information is known about solvent exposure of residues; one example is a site of post-translational attachment of carbohydrate which is necessarily on the surface of the protein. When experimental structural information is not available or is not feasible to obtain, methods are also available to analyze the primary amino acid sequence in order to make predictions of protein tertiary and secondary structure, solvent accessibility and the occurrence of turns and loops. Biochemical methods are also sometimes applicable for empirically determining surface exposure when direct structural methods are not feasible; for example, using the identification of sites of chain scission following limited proteolysis in order to infer surface exposure (Gentile and Salvatore, (1993) *Eur. J. Biochem.* 218:603-621). Thus using either the experimentally derived structural information or predictive methods (e.g., Srinivisan and Rose, (1995) *Proteins: Struct., Funct. & Genetics* 22:81-99) the parental amino acid sequence is inspected to classify regions according to whether or not they are integral to the maintenance of secondary and tertiary structure. The occurrence of sequences within regions that are known to be involved in periodic secondary structure (alpha and 3-10 helices, parallel and anti-parallel beta sheets) are regions that should be avoided. Similarly, regions of amino acid sequence that are observed or predicted to have a low degree of solvent exposure are more likely to be part of the so-called hydrophobic core of the protein and should also be avoided for selection of amino and carboxyl termini. In contrast, those regions that are known or predicted to be in surface turns or loops, and especially those regions that are known not to be required for biological activity, are the preferred sites for location of the extremes of the polypeptide chain. Continuous stretches of amino acid sequence that are preferred based on the above criteria are referred to as a breakpoint region. Polynucleotides encoding circular permuted IPD090 polypeptides with new N-terminus/C-terminus which contain a linker region separating the original C-terminus and N-terminus can be made essentially following the method described in Mullins, et al., (1994) *J. Am. Chem. Soc.* 116:5529-5533. Multiple steps of polymerase chain reaction (PCR) amplifications are used to rearrange the DNA sequence encoding the primary amino acid sequence of the protein. Polynucleotides encoding circular permuted IPD090 polypeptides with new N-terminus/C-terminus which contain a linker region separating the original C-terminus and N-terminus can be made based on the tandem-duplication method described in Horlick, et al., (1992) *Protein Eng.* 5:427-431. Polymerase chain reaction (PCR) amplification of the new N-terminus/C-terminus genes is performed using a tandemly duplicated template DNA.

In another embodiment fusion proteins are provided that include within its amino acid sequence an amino acid sequence comprising an IPD090 polypeptide or chimeric IPD090 polypeptide of the disclosure. Methods for design and construction of fusion proteins (and polynucleotides encoding same) are known to those of skill in the art. Polynucleotides encoding an IPD090 polypeptide may be fused to signal sequences which will direct the localization of the IPD090 polypeptide to particular compartments of a prokaryotic or eukaryotic cell and/or direct the secretion of the IPD090 polypeptide of the embodiments from a prokaryotic or eukaryotic cell. For example, in *E. coli*, one may wish to direct the expression of the protein to the periplasmic space. Examples of signal sequences or proteins (or fragments thereof) to which the IPD090 polypeptide may be fused in order to direct the expression of the polypeptide to the periplasmic space of bacteria include, but are not limited to, the pelB signal sequence, the maltose binding protein (MBP) signal sequence, MBP, the ompA signal sequence, the signal sequence of the periplasmic *E. coli* heat-labile enterotoxin B-subunit and the signal sequence of alkaline phosphatase. Several vectors are commercially available for the construction of fusion proteins which will direct the localization of a protein, such as the pMAL series of vectors (particularly the pMAL-p series) available from New England Biolabs. In a specific embodiment, the IPD090 polypeptide may be fused to the pelB pectate lyase signal sequence to increase the efficiency of expression and purification of such polypeptides in Gram-negative bacteria (see, U.S. Pat. Nos. 5,576,195 and 5,846,818). Plant plastid transit peptide/polypeptide fusions are well known in the art. Apoplast transit peptides such as rice or barley alpha-amylase secretion signal are also well known in the art. The plastid transit peptide is generally fused N-terminal to the polypeptide to be targeted (e.g., the fusion partner). In one embodiment, the fusion protein consists essentially of the plastid transit peptide and the IPD090 polypeptide to be targeted. In another embodiment, the fusion protein comprises the plastid transit peptide and the polypeptide to be targeted. In such embodiments, the plastid transit peptide is preferably at the N-terminus of the fusion protein. However, additional amino acid residues may be N-terminal to the plastid transit peptide providing that the fusion protein is at least partially targeted to a plastid. In a specific embodiment, the plastid transit peptide is in the N-terminal half, N-terminal third or N-terminal quarter of the fusion protein. Most or all of the plastid transit peptide is generally cleaved from the fusion protein upon insertion into the plastid. The position of cleavage may vary slightly between plant species, at different plant developmental stages, as a result of specific intercellular conditions or the particular combination of transit peptide/fusion partner used. In one embodiment, the plastid transit peptide cleavage is homogenous such that the cleavage site is identical in a population of fusion proteins. In another embodiment, the plastid transit peptide is not homogenous, such that the cleavage site varies by 1-10 amino acids in a population of fusion proteins. The plastid transit peptide can be recombinantly fused to a second protein in one of several ways. For example, a restriction endonuclease recognition site can be introduced into the nucleotide sequence of the transit peptide at a position corresponding to its C-terminal end and the same or a compatible site can be engineered into the nucleotide sequence of the protein to be targeted at its N-terminal end. Care must be taken in designing these sites to ensure that the coding sequences of the transit peptide and the second protein are kept "in frame" to allow the synthesis of the desired fusion protein. In some cases, it may be preferable to remove the initiator methionine of the second protein when the new restriction site is introduced. The introduction of restriction endonuclease recognition sites on both parent molecules and their subsequent joining through recombinant DNA techniques may result in the addition of one or more extra amino acids between the transit peptide and the second protein. This generally does not affect targeting activity as long as the transit peptide cleavage site remains accessible and the function of the second protein is not altered by the addition of these extra amino acids at its N-terminus. Alternatively, one skilled in the art can create a precise cleavage site between the transit peptide and the second protein (with or without its initiator methionine) using gene synthesis (Stemmer, et al., (1995) *Gene* 164:49-53) or similar methods. In addition, the transit peptide fusion can intentionally include amino acids downstream of the cleavage site. The amino acids at the N-terminus of the mature protein can affect the ability of the transit peptide to target proteins to plastids and/or the efficiency of cleavage following protein import. This may be dependent on the protein to be targeted. See, e.g., Comai, et al., (1988) *J. Biol. Chem.* 263(29): 15104-9. In some embodiments the IPD090 polypeptide is fused to a heterologous signal peptide or heterologous transit peptide.

In some embodiments fusion proteins are provide comprising an IPD090 polypeptide or chimeric IPD090 polypeptide of the disclosure represented by a formula selected from the group consisting of:

$R^1$-L-$R^2$, $R^2$-L-$R^1$, $R^1$-$R^2$ or $R^2$-$R^1$ wherein $R^1$ is an IPD090 polypeptide or chimeric IPD090 polypeptide of the disclosure and $R^2$ is a protein of interest. In some embodiments $R^1$ and $R^2$ are an IPD090 polypeptide or chimeric IPD090 polypeptide of the disclosure. The $R^1$ polypeptide is fused either directly or through a linker (L) segment to the $R^2$ polypeptide. The term "directly" defines fusions in which the polypeptides are joined without a peptide linker. Thus "L" represents a chemical bound or polypeptide segment to which both $R^1$ and $R^2$ are fused in frame, most commonly L is a linear peptide to which $R^1$ and $R^2$ are bound by amide bonds linking the carboxy terminus of $R^1$ to the amino terminus of L and carboxy terminus of L to the amino terminus of $R^2$. By "fused in frame" is meant that there is no translation termination or disruption between the reading frames of $R^1$ and $R^2$. The linking group (L) is generally a polypeptide of between 1 and 500 amino acids in length. The linkers joining the two molecules are preferably designed to (1) allow the two molecules to fold and act independently of each other, (2) not have a propensity for developing an ordered secondary structure which could interfere with the functional domains of the two proteins, (3) have minimal hydrophobic or charged characteristic which could interact with the functional protein domains and (4) provide steric separation of $R^1$ and $R^2$ such that $R^1$ and $R^2$ could interact simultaneously with their corresponding receptors on a single cell. Typically surface amino acids in flexible protein regions include Gly, Asn and Ser. Virtually any permutation of amino acid sequences containing Gly, Asn and Ser would be expected to satisfy the above criteria for a linker sequence. Other neutral amino acids, such as Thr and Ala, may also be used in the linker sequence. Additional amino acids may also be included in the linkers due to the addition of unique restriction sites in the linker sequence to facilitate construction of the fusions.

In some embodiments the linkers comprise sequences selected from the group of formulas: $(Gly_3Ser)_n$, $(Gly_4Ser)_n$, $(Gly_5Ser)_n$, $(Gly_nSer)_n$ or $(AlaGlySer)_n$ where n is an integer. One example of a highly-flexible linker is the (GlySer)-rich spacer region present within the pIII protein of the filamentous bacteriophages, e.g. bacteriophages M13 or fd (Schaller, et al., 1975). This region provides a long, flexible spacer region between two domains of the pIII surface protein. Also included are linkers in which an endopeptidase recognition sequence is included. Such a cleavage site may be valuable to separate the individual components of the fusion to determine if they are properly folded and active in vitro. Examples of various endopeptidases include, but are not limited to, Plasmin, Enterokinase, Kallikerin, Urokinase, Tissue Plasminogen activator, clostripain, Chymosin, Collagenase, Russell's Viper Venom Protease, Postproline cleavage enzyme, V8 protease, Thrombin and factor Xa. In some embodiments the linker comprises the amino acids EEKKN (SEQ ID NO: 376) from the multi-gene expression vehicle (MGEV), which is cleaved by vacuolar proteases as disclosed in US Patent Application Publication Number US 2007/0277263. In other embodiments, peptide linker segments from the hinge region of heavy chain immunoglobulins IgG, IgA, IgM, IgD or IgE provide an angular relationship between the attached polypeptides. Especially useful are those hinge regions where the cysteines are replaced with serines. Linkers of the present disclosure include sequences derived from murine IgG gamma 2b hinge region in which the cysteines have been changed to serines. The fusion proteins are not limited by the form, size or number of linker sequences employed and the only requirement of the linker is that functionally it does not interfere adversely with the folding and function of the individual molecules of the fusion.

Nucleic Acid Molecules, and Variants and Fragments Thereof

Isolated or recombinant nucleic acid molecules comprising nucleic acid sequences encoding IPD090 polypeptides or biologically active portions thereof, as well as nucleic acid molecules sufficient for use as hybridization probes to identify nucleic acid molecules encoding proteins with regions of sequence homology are provided. As used herein, the term "nucleic acid molecule" refers to DNA molecules (e.g., recombinant DNA, cDNA, genomic DNA, plastid DNA, mitochondrial DNA) and RNA molecules (e.g., mRNA) and analogs of the DNA or RNA generated using nucleotide analogs. The nucleic acid molecule can be single-stranded or double-stranded, but preferably is double-stranded DNA.

An "isolated" nucleic acid molecule (or DNA) is used herein to refer to a nucleic acid sequence (or DNA) that is no longer in its natural environment, for example in vitro. A "recombinant" nucleic acid molecule (or DNA) is used herein to refer to a nucleic acid sequence (or DNA) that is in a recombinant bacterial or plant host cell. In some embodiments, an "isolated" or "recombinant" nucleic acid is free of sequences (preferably protein encoding sequences) that naturally flank the nucleic acid (i.e., sequences located at the 5' and 3' ends of the nucleic acid) in the genomic DNA of the organism from which the nucleic acid is derived. For purposes of the disclosure, "isolated" or "recombinant" when used to refer to nucleic acid molecules excludes isolated chromosomes. For example, in various embodiments, the recombinant nucleic acid molecules encoding IPD090 polypeptides can contain less than about 5 kb, 4 kb, 3 kb, 2 kb, 1 kb, 0.5 kb or 0.1 kb of nucleic acid sequences that naturally flank the nucleic acid molecule in genomic DNA of the cell from which the nucleic acid is derived.

In some embodiments an isolated nucleic acid molecule encoding IPD090 polypeptides has one or more change in the nucleic acid sequence compared to the native or genomic nucleic acid sequence. In some embodiments the change in the native or genomic nucleic acid sequence includes but is not limited to: changes in the nucleic acid sequence due to the degeneracy of the genetic code; changes in the nucleic acid sequence due to the amino acid substitution, insertion, deletion and/or addition compared to the native or genomic sequence; removal of one or more intron; deletion of one or more upstream or downstream regulatory regions; and deletion of the 5' and/or 3' untranslated region associated with the genomic nucleic acid sequence. In some embodiments the nucleic acid molecule encoding an IPD090 polypeptide is a non-genomic sequence.

A variety of polynucleotides that encode IPD090 polypeptides or related proteins are contemplated. Such polynucleotides are useful for production of IPD090 polypeptides in host cells when operably linked to a suitable promoter, transcription termination and/or polyadenylation sequences. Such polynucleotides are also useful as probes for isolating homologous or substantially homologous polynucleotides that encode IPD090 polypeptides or related proteins.

Polynucleotides Encoding IPD090 Polypeptides

One source of polynucleotides that encode IPD090 polypeptides or related proteins is a *Pseudomonas* or *Woodsholea* bacterium which contains an IPD090 polynucleotide of SEQ ID NO: 1, SEQ ID NO: 3, SEQ ID NO: 5, SEQ ID NO: 378, and SEQ ID NO: 380, encoding an IPD090 polypeptide of SEQ ID NO: 2, SEQ ID NO: 4, SEQ ID NO: 6, SEQ ID NO: 379, and SEQ ID NO: 384, respectively. The polynucleotides of SEQ ID NO: 1, SEQ ID NO: 3, SEQ ID NO: 5, SEQ ID NO: 378 or SEQ ID NO: 380 can be used to express IPD090 polypeptides in recombinant bacterial hosts that include but are not limited to *Agrobacterium, Bacillus, Escherichia, Salmonella, Pseudomonas* and *Rhizobium* bacterial host cells. The polynucleotides are also useful as probes for isolating homologous or substantially homologous polynucleotides that encode IPD090 polypeptides or related proteins. Such probes can be used to identify homologous or substantially homologous polynucleotides derived from *Pseudomonas* species.

Polynucleotides that encode IPD090 polypeptides can also be synthesized de novo from an IPD090 polypeptide sequence. The sequence of the polynucleotide gene can be deduced from an IPD090 polypeptide sequence through use of the genetic code. Computer programs such as "BackTranslate" (GCG™ Package, Acclerys, Inc. San Diego, Calif.) can be used to convert a peptide sequence to the corresponding nucleotide sequence encoding the peptide. Examples of IPD090 polypeptide sequences that can be used to obtain corresponding nucleotide encoding sequences include, but are not limited to the IPD090 polypeptides of SEQ ID NO: 2, SEQ ID NO: 4, SEQ ID NO: 6, SEQ ID NO: 379, and SEQ ID NO: 384. Furthermore, synthetic IPD090 polynucleotide sequences of the disclosure can be designed so that they will be expressed in plants.

In some embodiments the nucleic acid molecule encoding an IPD090 polypeptide is a polynucleotide having the sequence set forth in SEQ ID NO: 1, SEQ ID NO: 3, SEQ ID NO: 5, SEQ ID NO: 378 or SEQ ID NO: 380, and variants, fragments and complements thereof. "Complement" is used herein to refer to a nucleic acid sequence that is sufficiently complementary to a given nucleic acid sequence such that it can hybridize to the given nucleic acid sequence to thereby form a stable duplex. "Polynucleotide sequence variants" is used herein to refer to a nucleic acid sequence that except for the degeneracy of the genetic code encodes the same polypeptide.

In some embodiments the nucleic acid molecule encoding the IPD090 polypeptide is a non-genomic nucleic acid sequence. As used herein a "non-genomic nucleic acid sequence" or "non-genomic nucleic acid molecule" or "non-genomic polynucleotide" refers to a nucleic acid molecule that has one or more change in the nucleic acid sequence compared to a native or genomic nucleic acid sequence. In some embodiments the change to a native or genomic nucleic acid molecule includes but is not limited to: changes in the nucleic acid sequence due to the degeneracy of the genetic code; optimization of the nucleic acid sequence for expression in plants; changes in the nucleic acid sequence to introduce at least one amino acid substitution, insertion, deletion and/or addition compared to the native or genomic sequence; removal of one or more intron associated with the genomic nucleic acid sequence; insertion of one or more heterologous introns; deletion of one or more upstream or downstream regulatory regions associated with the genomic nucleic acid sequence; insertion of one or more heterologous upstream or downstream regulatory regions; deletion of the 5' and/or 3' untranslated region associated with the genomic nucleic acid sequence; insertion of a heterologous 5' and/or 3' untranslated region; and modification of a polyadenylation site. In some embodiments the non-genomic nucleic acid molecule is a synthetic nucleic acid sequence.

In some embodiments the nucleic acid molecule encoding an IPD090 polypeptide is a non-genomic polynucleotide having a nucleotide sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or greater identity, to the nucleic acid sequence of SEQ ID NO: 1, SEQ ID NO: 3, SEQ ID NO: 5, SEQ ID NO: 378 or SEQ ID NO: 380, wherein the IPD090 polypeptide has insecticidal activity.

In some embodiments the nucleic acid molecule encodes an IPD090 polypeptide comprising an amino acid sequence of, SEQ ID NO: 2, SEQ ID NO: 4, SEQ ID NO: 6, SEQ ID NO: 379 or SEQ ID NO: 384 having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95 or more amino acid substitutions compared to the native amino acid at the corresponding position of SEQ ID NO: 2, SEQ ID NO: 4, SEQ ID NO: 6, SEQ ID NO: 379 or SEQ ID NO: 384.

In some embodiments the nucleic acid molecule encodes an IPD090 polypeptide variant comprising any one or more amino acid substitutions corresponding to positions 3, 4, 8, 12, 15, 16, 21, 23, 24, 26, 28, 30, 38, 46, 47, 50, 52, 55, 62, 63, 67, 68, 70, 73, 74, 75, 76, 80, 90, 91, 94, 99, 100, 108, 115, 127, 129, 161, 169, 175, 177, 178, 180, 185, 207, 213, 223, 240, 241, 247, 255, 266, 273, 275, 277, 278, 287, 288, 302, 306, 309, 310, 311, 312, 316, 317, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, 358, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, 391, 392, 395, 397, 400, 401, 402, 405, 407, 410, 423, 425, 426, 431, 433, 434, 437, 438, 439, 440, 441, 442, 443, 444, 445, 446, 447, 448, 449, 450, 451, 452, 453, 454, 455, 457, 458, 459, 460, 468, and 471 of SEQ ID NO: 2, in any combination.

In some embodiments the nucleic acid molecule encodes an IPD090 polypeptide variant comprising any one or more amino acid substitutions of Table 10 or 12.

Also provided are nucleic acid molecules that encode transcription and/or translation products that are subsequently spliced to ultimately produce functional IPD090 polypeptides. Splicing can be accomplished in vitro or in vivo, and can involve cis- or trans-splicing. The substrate for splicing can be polynucleotides (e.g., RNA transcripts) or polypeptides. An example of cis-splicing of a polynucleotide is where an intron inserted into a coding sequence is removed and the two flanking exon regions are spliced to generate an IPD090 polypeptide encoding sequence. An example of trans-splicing would be where a polynucleotide is encrypted by separating the coding sequence into two or more fragments that can be separately transcribed and then spliced to form the full-length pesticidal encoding sequence. The use of a splicing enhancer sequence, which can be introduced into a construct, can facilitate splicing either in cis or trans-splicing of polypeptides (U.S. Pat. Nos. 6,365, 377 and 6,531,316). Thus, in some embodiments the polynucleotides do not directly encode a full-length IPD090 polypeptide, but rather encode a fragment or fragments of an IPD090 polypeptide. These polynucleotides can be used to express a functional IPD090 polypeptide through a mechanism involving splicing, where splicing can occur at the level of polynucleotide (e.g., intron/exon) and/or polypeptide (e.g., intein/extein). This can be useful, for example, in controlling expression of pesticidal activity, since a functional pesticidal polypeptide will only be expressed if all required fragments are expressed in an environment that permits splicing processes to generate functional product. In another example, introduction of one or more insertion sequences into a polynucleotide can facilitate recombination with a low homology polynucleotide; use of an intron or intein for the insertion sequence facilitates the removal of the intervening sequence, thereby restoring function of the encoded variant.

Nucleic acid molecules that are fragments of these nucleic acid sequences encoding IPD090 polypeptides are also encompassed by the embodiments. "Fragment" as used herein refers to a portion of the nucleic acid sequence encoding an IPD090 polypeptide. A fragment of a nucleic acid sequence may encode a biologically active portion of an IPD090 polypeptide or it may be a fragment that can be used as a hybridization probe or PCR primer using methods disclosed below. Nucleic acid molecules that are fragments of a nucleic acid sequence encoding an IPD090 polypeptide comprise at least about 150, 180, 210, 240, 270, 300, 330 or 360, contiguous nucleotides or up to the number of nucleotides present in a full-length nucleic acid sequence encoding an IPD090 polypeptide disclosed herein, depending upon the intended use. "Contiguous nucleotides" is used herein to refer to nucleotide residues that are immediately adjacent to one another. Fragments of the nucleic acid sequences of the embodiments will encode protein fragments that retain the biological activity of the IPD090 polypeptide and, hence, retain insecticidal activity. "Retains insecticidal activity" is used herein to refer to a polypeptide having at least about 10%, at least about 30%, at least about 50%, at least about 70%, 80%, 90%, 95% or higher of the insecticidal activity of the full-length IPD090Aa polypeptide (SEQ ID NO: 2). In some embodiments, the insecticidal activity is against a Lepidopteran species. In one embodiment, the insecticidal activity is against a Coleopteran species. In some embodiments, the insecticidal activity is against one or more insect pests of the corn rootworm complex: western corn rootworm, *Diabrotica virgifera*; northern corn rootworm, *D. barberi*: Southern corn rootworm or spotted cucumber beetle; *Diabrotica undecimpunctata howardi*, and the Mexican corn rootworm, *D. virgifera zeae*. In one embodiment, the insecticidal activity is against a *Diabrotica* species.

In some embodiments the IPD090 polypeptide is encoded by a nucleic acid sequence sufficiently homologous to the nucleic acid sequence of SEQ ID NO: 1, SEQ ID NO: 3, SEQ ID NO: 5, SEQ ID NO: 378 or SEQ ID NO: 380. "Sufficiently homologous" is used herein to refer to an amino acid or nucleic acid sequence that has at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence homology compared to a reference sequence using one of the alignment programs described herein using standard parameters. One of skill in the art will recognize that these values can be appropriately adjusted to determine corresponding homology of proteins encoded by two nucleic acid sequences by taking into account degeneracy, amino acid similarity, reading frame positioning, and the like. In some embodiments the sequence homology is against the full length sequence of the polynucleotide encoding an IPD090 polypeptide or against the full length sequence of an IPD090 polypeptide.

In some embodiments the nucleic acid encodes an IPD090 polypeptide having at least about 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or greater sequence identity compared to SEQ ID NO: 2, SEQ ID NO: 4, SEQ ID NO: 6, SEQ ID NO: 379 or SEQ ID NO: 384. In some embodiments the sequence identity is calculated using ClustalW algorithm in the ALIGNX® module of the Vector NTI® Program Suite (Invitrogen Corporation, Carlsbad, Calif.) with all default parameters. In some embodiments the sequence identity is across the entire length of polypeptide calculated using ClustalW algorithm in the ALIGNX module of the Vector NTI Program Suite (Invitrogen Corporation, Carlsbad, Calif.) with all default parameters.

To determine the percent identity of two amino acid sequences or of two nucleic acid sequences, the sequences are aligned for optimal comparison purposes. The percent identity between the two sequences is a function of the number of identical positions shared by the sequences (i.e., percent identity=number of identical positions/total number of positions (e.g., overlapping positions)×100). In one embodiment, the two sequences are the same length. In another embodiment, the comparison is across the entirety of the reference sequence (e.g., across the entirety of SEQ ID NO: 1). The percent identity between two sequences can be determined using techniques similar to those described below, with or without allowing gaps. In calculating percent identity, typically exact matches are counted.

Another non-limiting example of a mathematical algorithm utilized for the comparison of sequences is the algorithm of Needleman and Wunsch, (1970) *J. Mol. Biol.* 48(3):443-453, used GAP Version 10 software to determine sequence identity or similarity using the following default parameters: % identity and % similarity for a nucleic acid sequence using GAP Weight of 50 and Length Weight of 3, and the nwsgapdna.cmpii scoring matrix; % identity or % similarity for an amino acid sequence using GAP weight of 8 and length weight of 2, and the BLOSUM62 scoring program. Equivalent programs may also be used. "Equivalent program" is used herein to refer to any sequence comparison program that, for any two sequences in question, generates an alignment having identical nucleotide residue matches and an identical percent sequence identity when compared to the corresponding alignment generated by GAP Version 10.

In some embodiments an IPD090 polynucleotide encodes an IPD090 polypeptide comprising an amino acid sequence having at least about 80%, 81%, 82%, 83%, 84%, 85%, 86%, 87%, 88%, 89%, 90%, 91%, 92%, 93%, 94%, 95%, 96%, 97%, 98%, 99% or greater identity across the entire length of the amino acid sequence of SEQ ID NO: 2.

In some embodiments polynucleotides are provided encoding chimeric polypeptides comprising regions of at least two different IPD090 polypeptides of the disclosure.

In some embodiments polynucleotides are provided encoding chimeric polypeptides comprising regions of at least two different IPD090 polypeptides selected from SEQ ID NO: 2, SEQ ID NO: 4, SEQ ID NO: 6, SEQ ID NO: 8, SEQ ID NO: 10, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 321, SEQ ID NO: 322, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 377, SEQ ID NO: 379, and SEQ ID NO: 384.

In some embodiments polynucleotides are provided encoding chimeric polypeptides comprising an N-terminal Region of a first IPD090 polypeptide of the disclosure operably fused to a C-terminal Region of a second IPD090 polypeptide of the disclosure.

In some embodiments polynucleotides are provided encoding chimeric polypeptides comprising an N-terminal Region of a first IPD090 polypeptide operably fused to a C-terminal Region of a second IPD090 polypeptide, where the IPD090 polypeptide is selected from SEQ ID NO: 2, SEQ ID NO: 4, SEQ ID NO: 6, SEQ ID NO: 8, SEQ ID NO: 10, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 321, SEQ ID NO: 322, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 377, SEQ ID NO: 379, and SEQ ID NO: 384.

In some embodiments polynucleotides are provided encoding chimeric polypeptides comprising; a) an N-terminal Region having at least 90% sequence identity to the amino acid residues corresponding to amino acids 1 to about 144, amino acids 1 to about 239, amino acids 1 to about 296, amino acids 1 to about 348, amino acids 1 to about 382, amino acids 1 to about 422, amino acids 1 to about 442 of SEQ ID NO: 2 or SEQ ID NO: 4; and b) a C-terminal Region having at least 90% sequence identity to the amino acid residues corresponding to amino acids of about 146 to about 483, amino acids of about 241 to about 483, amino acids of about 297 to about 483, amino acids of about 349 to about 483, amino acids of about 383 to about 483, amino acids of about 423 to about 483 or amino acids of about 443 to about 483 of SEQ ID NO: 6.

In some embodiments polynucleotides are provided encoding chimeric polypeptides comprising; a) an N-terminal Region having at least 90% sequence identity to the amino acid residues corresponding to amino acids 1 to about 144 of SEQ ID NO: 2 or SEQ ID NO: 4; and b) a C-terminal Region having at least 90% sequence identity to the amino acid residues corresponding to amino acids of about 146 to 483 of SEQ ID NO: 6.

In some embodiments polynucleotides are provided encoding chimeric polypeptides comprising; a) an N-terminal Region having at least 90% sequence identity to the amino acid residues corresponding to amino acids 1 to about 239 of SEQ ID NO: 2 or SEQ ID NO: 4; and b) a C-terminal Region having at least 90% sequence identity to the amino acid residues corresponding to amino acids of about 241 to 483 of SEQ ID NO: 6.

In some embodiments polynucleotides are provided encoding chimeric polypeptides comprising; a) an N-terminal Region having at least 90% sequence identity to the amino acid residues corresponding to amino acids 1 to about 296 of SEQ ID NO: 2 or SEQ ID NO: 4; and b) a C-terminal Region having at least 90% sequence identity to the amino acid residues corresponding to amino acids of about 297 to about 483 of SEQ ID NO: 6.

In some embodiments polynucleotides are provided encoding chimeric polypeptides comprising; a) an N-terminal Region having at least 90% sequence identity to the amino acid residues corresponding to amino acids 1 to about 348 of SEQ ID NO: 2 or SEQ ID NO: 4; and b) a C-terminal Region having at least 90% sequence identity to the amino acid residues corresponding to amino acids of about 349 to 483 of SEQ ID NO: 6.

In some embodiments polynucleotides are provided encoding chimeric polypeptides comprising; a) an N-terminal Region having at least 90% sequence identity to the amino acid residues corresponding to amino acids 1 to about 382 of SEQ ID NO: 2 or SEQ ID NO: 4; and b) a C-terminal Region having at least 90% sequence identity to the amino acid residues corresponding to amino acids of about 383 to 483 of SEQ ID NO: 6.

In some embodiments polynucleotides are provided encoding chimeric polypeptides comprising; a) an N-terminal Region having at least 90% sequence identity to the amino acid residues corresponding to amino acids 1 to about 422 of SEQ ID NO: 2 or SEQ ID NO: 4; and b) a C-terminal Region having at least 90% sequence identity to the amino acid residues corresponding to amino acids about 423 to 483 of SEQ ID NO: 6.

In some embodiments polynucleotides are provided encoding chimeric polypeptides comprising; a) an N-terminal Region having at least 90% sequence identity to the amino acid residues corresponding to amino acids 1 to about 442 of SEQ ID NO: 2 or SEQ ID NO: 4; and b) a C-terminal Region having at least 90% sequence identity to the amino acid residues corresponding to amino acids about 443 to 483 of SEQ ID NO: 6.

In some embodiments polynucleotides are provided encoding chimeric polypeptides comprising; a) an N-terminal Region comprising the acids 1 to about 144, amino acids 1 to about 239, amino acids 1 to about 296, amino acids 1 to about 348, amino acids 1 to about 382, amino acids 1 to about 422, amino acids 1 to about 442 of SEQ ID NO: 2, SEQ ID NO: 4 or SEQ ID NO: 6; and b) a C-terminal Region comprising the amino acids of about 146 to about 483, amino acids of about 241 to about 483, amino acids of about 297 to about 483, amino acids of about 349 to about 483, amino acids of about 383 to about 483, amino acids of about 423 to about 483 or amino acids of about 443 to about 483 of SEQ ID NO: 2, SEQ ID NO: 4 or SEQ ID NO: 6.

In some embodiments polynucleotides are provided encoding chimeric polypeptides comprising; a) an N-terminal Region comprising amino acids 1 to about 144 of SEQ ID NO: 2 or SEQ ID NO: 4; and b) a C-terminal Region comprising amino acids of about 146 to 483 of SEQ ID NO: 6.

In some embodiments polynucleotides are provided encoding chimeric polypeptides comprising; a) an N-terminal Region comprising amino acids 1 to about 239 of SEQ ID NO: 2 or SEQ ID NO: 4; and b) a C-terminal Region comprising amino acids of about 241 to 483 of SEQ ID NO: 6.

In some embodiments polynucleotides are provided encoding chimeric polypeptides comprising; a) an N-terminal Region comprising amino acids 1 to about 296 of SEQ ID NO: 2 or SEQ ID NO: 4; and b) a C-terminal Region comprising amino acids of about 297 to about 483 of SEQ ID NO: 6.

In some embodiments polynucleotides are provided encoding chimeric polypeptides comprising; a) an N-terminal Region comprises amino acids 1 to about 348 of SEQ ID NO: 2 or SEQ ID NO: 4; and b) a C-terminal Region comprising amino acids of about 349 to 483 of SEQ ID NO: 6.

In some embodiments polynucleotides are provided encoding chimeric polypeptides comprising; a) an N-terminal Region comprising amino acids 1 to about 382 of SEQ ID NO: 2 or SEQ ID NO: 4; and b) a C-terminal Region comprising amino acids of about 383 to 483 of SEQ ID NO: 6.

In some embodiments polynucleotides are provided encoding chimeric polypeptides comprising; a) an N-terminal Region comprising amino acids 1 to about 422 of SEQ ID NO: 2 or SEQ ID NO: 4; and b) a C-terminal Region comprising amino acids about 423 to 483 of SEQ ID NO: 6.

In some embodiments polynucleotides are provided encoding chimeric polypeptides comprising; a) an N-terminal Region comprising amino acids 1 to about 442 of SEQ ID NO: 2 or SEQ ID NO: 4; and b) a C-terminal Region comprising amino acids about 443 to 483 of SEQ ID NO: 6.

In some embodiments an IPD090 polynucleotide encodes an IPD090 polypeptide comprising an amino acid sequence of, SEQ ID NO: 2, SEQ ID NO: 4, SEQ ID NO: 6, SEQ ID NO: 379 or SEQ ID NO: 384, having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 85, 86, 87, 88, 89, 90 or more amino acid substitutions compared to the native amino acid at the corresponding position of SEQ ID NO: 2, SEQ ID NO: 4, SEQ ID NO: 6, SEQ ID NO: 379 or SEQ ID NO: 384.

In some embodiments an IPD090 polynucleotide encodes an IPD090 polypeptide comprising an amino acid sequence having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71 or 72 amino acid substitutions, in any combination, compared to the native amino acid at the corresponding position of SEQ ID NO: 2, SEQ ID NO: 4, SEQ ID NO: 6, SEQ ID NO: 379 or SEQ ID NO: 384.

In some embodiments an IPD090 polynucleotide encodes an IPD090 polypeptide comprising an amino acid sequence having 1, 2, 3, 4, 5, 6, 7, 8, 9, 10 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47 or 48 amino acid substitutions, in any combination, compared to the native amino acid at the corresponding position of SEQ ID NO: 2, SEQ ID NO: 4, SEQ ID NO: 6, SEQ ID NO: 379 or SEQ ID NO: 384.

In some embodiments an IPD090 polynucleotide encodes an IPD090 polypeptide comprising an amino acid sequence having 1, 2, 3, 4, 5, 6, 7, 8, 9, 10 11, 12, 13, 14, 15, 16, 17, 18, 19, 20, 21, 22, 23 or 24 amino acid substitutions, in any combination, compared to the native amino acid at the corresponding position of SEQ ID NO: 2, SEQ ID NO: 4, SEQ ID NO: 6, SEQ ID NO: 379 or SEQ ID NO: 384.

In some embodiments an IPD090 polynucleotide encodes the IPD090 polypeptide comprising an amino acid sequence of SEQ ID NO: 2, SEQ ID NO: 4, SEQ ID NO: 6, SEQ ID NO: 10, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 321, SEQ ID NO: 322, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 377, SEQ ID NO: 379, and SEQ ID NO: 384.

The embodiments also encompass nucleic acid molecules encoding IPD090 polypeptide variants. "Variants" of the IPD090 polypeptide encoding nucleic acid sequences include those sequences that encode the IPD090 polypeptides disclosed herein but that differ conservatively because of the degeneracy of the genetic code as well as those that are sufficiently identical as discussed above. Naturally occurring allelic variants can be identified with the use of well-known molecular biology techniques, such as polymerase chain reaction (PCR) and hybridization techniques as outlined below. Variant nucleic acid sequences also include synthetically derived nucleic acid sequences that have been generated, for example, by using site-directed mutagenesis but which still encode the IPD090 polypeptides disclosed as discussed below.

The present disclosure provides isolated or recombinant polynucleotides that encode any of the IPD090 polypeptides disclosed herein. Those having ordinary skill in the art will readily appreciate that due to the degeneracy of the genetic code, a multitude of nucleotide sequences encoding IPD090 polypeptides of the present disclosure exist.

The skilled artisan will further appreciate that changes can be introduced by mutation of the nucleic acid sequences thereby leading to changes in the amino acid sequence of the encoded IPD090 polypeptides, without altering the biological activity of the proteins. Thus, variant nucleic acid molecules can be created by introducing one or more nucleotide substitutions, additions and/or deletions into the corresponding nucleic acid sequence disclosed herein, such that one or more amino acid substitutions, additions or deletions are introduced into the encoded protein. Mutations can be introduced by standard techniques, such as site-directed mutagenesis and PCR-mediated mutagenesis. Such variant nucleic acid sequences are also encompassed by the present disclosure.

Alternatively, variant nucleic acid sequences can be made by introducing mutations randomly along all or part of the coding sequence, such as by saturation mutagenesis, and the resultant mutants can be screened for ability to confer pesticidal activity to identify mutants that retain activity. Following mutagenesis, the encoded protein can be expressed recombinantly, and the activity of the protein can be determined using standard assay techniques.

The polynucleotides of the disclosure and fragments thereof are optionally used as substrates for a variety of recombination and recursive recombination reactions, in addition to standard cloning methods as set forth in, e.g., Ausubel, Berger and Sambrook, i.e., to produce additional pesticidal polypeptide homologues and fragments thereof with desired properties. A variety of such reactions are known, including those developed by the inventors and their co-workers. Methods for producing a variant of any nucleic acid listed herein comprising recursively recombining such polynucleotide with a second (or more) polynucleotide, thus forming a library of variant polynucleotides are also embodiments of the disclosure, as are the libraries produced, the cells comprising the libraries and any recombinant polynucleotide produced by such methods. Additionally, such methods optionally comprise selecting a variant polynucleotide from such libraries based on pesticidal activity, as is wherein such recursive recombination is done in vitro or in vivo.

A variety of diversity generating protocols, including nucleic acid recursive recombination protocols are available and fully described in the art. The procedures can be used separately, and/or in combination to produce one or more variants of a nucleic acid or set of nucleic acids, as well as variants of encoded proteins. Individually and collectively, these procedures provide robust, widely applicable ways of generating diversified nucleic acids and sets of nucleic acids (including, e.g., nucleic acid libraries) useful, e.g., for the engineering or rapid evolution of nucleic acids, proteins, pathways, cells and/or organisms with new and/or improved characteristics.

While distinctions and classifications are made in the course of the ensuing discussion for clarity, it will be appreciated that the techniques are often not mutually exclusive. Indeed, the various methods can be used singly or in combination, in parallel or in series, to access diverse sequence variants.

The result of any of the diversity generating procedures described herein can be the generation of one or more nucleic acids, which can be selected or screened for nucleic acids with or which confer desirable properties or that encode proteins with or which confer desirable properties. Following diversification by one or more of the methods herein or otherwise available to one of skill, any nucleic acids that are produced can be selected for a desired activity or property, e.g. pesticidal activity or, such activity at a desired pH, etc. This can include identifying any activity that can be detected, for example, in an automated or automatable format, by any of the assays in the art, see, e.g., discussion of screening of insecticidal activity, infra. A variety of related (or even unrelated) properties can be evaluated, in serial or in parallel, at the discretion of the practitioner.

Descriptions of a variety of diversity generating procedures for generating modified nucleic acid sequences, e.g., those coding for polypeptides having pesticidal activity or fragments thereof, are found in the following publications and the references cited therein: Soong, et al., (2000) *Nat Genet* 25(4):436-439; Stemmer, et al., (1999) *Tumor Targeting* 4:1-4; Ness, et al., (1999) *Nat Biotechnol* 17:893-896; Chang, et al., (1999) *Nat Biotechnol* 17:793-797; Minshull and Stemmer, (1999) *Curr Opin Chem Biol* 3:284-290; Christians, et al., (1999) *Nat Biotechnol* 17:259-264; Crameri, et al., (1998) *Nature* 391:288-291; Crameri, et al., (1997) *Nat Biotechnol* 15:436-438; Zhang, et al., (1997) *PNAS USA* 94:4504-4509; Patten, et al., (1997) *Curr Opin Biotechnol* 8:724-733; Crameri, et al., (1996) *Nat Med* 2:100-103; Crameri, et al., (1996) *Nat Biotechnol* 14:315-319; Gates, et al., (1996) *J Mol Biol* 255:373-386; Stemmer, (1996) "Sexual PCR and Assembly PCR" In: *The Encyclopedia of Molecular Biology*. VCH Publishers, New York. pp. 447-457; Crameri and Stemmer, (1995) *BioTechniques* 18:194-195; Stemmer, et al., (1995) *Gene,* 164:49-53; Stemmer, (1995) *Science* 270: 1510; Stemmer, (1995) *Bio/Technology* 13:549-553; Stemmer, (1994) *Nature* 370:389-391 and Stemmer, (1994) *PNAS USA* 91:10747-10751.

Mutational methods of generating diversity include, for example, site-directed mutagenesis (Ling, et al., (1997) *Anal Biochem* 254(2):157-178; Dale, et al., (1996) *Methods Mol Biol* 57:369-374; Smith, (1985) *Ann Rev Genet* 19:423-462; Botstein and Shortle, (1985) *Science* 229:1193-1201; Carter, (1986) *Biochem J* 237:1-7 and Kunkel, (1987) "The efficiency of oligonucleotide directed mutagenesis" in *Nucleic Acids & Molecular Biology* (Eckstein and Lilley, eds., Springer Verlag, Berlin)); mutagenesis using uracil containing templates (Kunkel, (1985) *PNAS USA* 82:488-492; Kunkel, et al., (1987) *Methods Enzymol* 154:367-382 and Bass, et al., (1988) *Science* 242:240-245); oligonucleotide-directed mutagenesis (Zoller and Smith, (1983) *Methods Enzymol* 100:468-500; Zoller and Smith, (1987) *Methods Enzymol* 154:329-350 (1987); Zoller and Smith, (1982) *Nucleic Acids Res* 10:6487-6500), phosphorothioate-modified DNA mutagenesis (Taylor, et al., (1985) *Nucl Acids Res* 13:8749-8764; Taylor, et al., (1985) *Nucl Acids Res* 13:8765-8787 (1985); Nakamaye and Eckstein, (1986) *Nucl Acids Res* 14:9679-9698; Sayers, et al., (1988) *Nucl Acids Res* 16:791-802 and Sayers, et al., (1988) *Nucl Acids Res* 16:803-814); mutagenesis using gapped duplex DNA (Kramer, et al., (1984) *Nucl Acids Res* 12:9441-9456; Kramer and Fritz, (1987) *Methods Enzymol* 154:350-367; Kramer, et al., (1988) *Nucl Acids Res* 16:7207 and Fritz, et al., (1988) *Nucl Acids Res* 16:6987-6999).

Additional suitable methods include point mismatch repair (Kramer, et al., (1984) *Cell* 38:879-887), mutagenesis using repair-deficient host strains (Carter, et al., (1985) *Nucl Acids Res* 13:4431-4443 and Carter, (1987) *Methods in Enzymol* 154:382-403), deletion mutagenesis (Eghtedarzadeh and Henikoff, (1986) *Nucl Acids Res* 14:5115), restriction-selection and restriction-purification (Wells, et al., (1986) *Phil Trans R Soc Lond A* 317:415-423), mutagenesis by total gene synthesis (Nambiar, et al., (1984) *Science* 223:1299-1301; Sakamar and Khorana, (1988) *Nucl Acids Res* 14:6361-6372; Wells, et al., (1985) *Gene* 34:315-323 and Grundström, et al., (1985) *Nucl Acids Res* 13:3305-3316), double-strand break repair (Mandecki, (1986) *PNAS USA,* 83:7177-7181 and Arnold, (1993) *Curr Opin Biotech* 4:450-455). Additional details on many of the above methods can be found in *Methods Enzymol* Volume 154, which also describes useful controls for trouble-shooting problems with various mutagenesis methods.

Additional details regarding various diversity generating methods can be found in the following US Patents, PCT Publications and Applications and EPO publications: U.S. Pat. Nos. 5,723,323, 5,763,192, 5,814,476, 5,817,483, 5,824,514, 5,976,862, 5,605,793, 5,811,238, 5,830,721, 5,834,252, 5,837,458, WO 1995/22625, WO 1996/33207, WO 1997/20078, WO 1997/35966, WO 1999/41402, WO 1999/41383, WO 1999/41369, WO 1999/41368, EP 752008, EP 0932670, WO 1999/23107, WO 1999/21979, WO 1998/31837, WO 1998/27230, WO 1998/27230, WO 2000/00632, WO 2000/09679, WO 1998/42832, WO 1999/29902, WO 1998/41653, WO 1998/41622, WO 1998/42727, WO 2000/18906, WO 2000/04190, WO 2000/42561, WO 2000/42559, WO 2000/42560, WO 2001/23401 and PCT/US01/06775.

The nucleotide sequences of the embodiments can also be used to isolate corresponding sequences from a bacterial source, including but not limited to a *Pseudomonas* species. In this manner, methods such as PCR, hybridization, and the like can be used to identify such sequences based on their sequence homology to the sequences set forth herein. Sequences that are selected based on their sequence identity to the entire sequences set forth herein or to fragments thereof are encompassed by the embodiments. Such sequences include sequences that are orthologs of the disclosed sequences. The term "orthologs" refers to genes derived from a common ancestral gene and which are found in different species as a result of speciation. Genes found in different species are considered orthologs when their nucleotide sequences and/or their encoded protein sequences share substantial identity as defined elsewhere herein. Functions of orthologs are often highly conserved among species.

In a PCR approach, oligonucleotide primers can be designed for use in PCR reactions to amplify corresponding DNA sequences from cDNA or genomic DNA extracted from any organism of interest. Methods for designing PCR primers and PCR cloning are generally known in the art and are disclosed in Sambrook, et al., (1989) *Molecular Cloning: A Laboratory Manual* (2d ed., Cold Spring Harbor Laboratory Press, Plainview, N.Y.), hereinafter "Sambrook". See also, Innis, et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Known methods of PCR include, but are not limited to, methods using paired primers, nested primers, single specific primers, degenerate primers, gene-specific primers, vector-specific primers, partially-mismatched primers, and the like.

To identify potential IPD090 polypeptides from bacterium collections, the bacterial cell lysates can be screened with antibodies generated against an IPD090 polypeptides and/or IPD090 polypeptides using Western blotting and/or ELISA methods. This type of assays can be performed in a high throughput fashion. Positive samples can be further analyzed by various techniques such as antibody based protein purification and identification. Methods of generating antibodies are well known in the art as discussed infra.

Alternatively, mass spectrometry based protein identification method can be used to identify homologs of IPD090 polypeptides using protocols in the literatures (Scott Patterson, (1998), 10.22, 1-24, Current Protocol in Molecular Biology published by John Wiley & Son Inc). Specifically, LC-MS/MS based protein identification method is used to associate the MS data of given cell lysate or desired molecular weight enriched samples (excised from SDS-PAGE gel of relevant molecular weight bands to IPD090 polypeptides) with sequence information of IPD090 polypeptides of SEQ ID NO: 2, SEQ ID NO: 4, SEQ ID NO: 6, SEQ ID NO: 8, SEQ ID NO: 10, SEQ ID NO: 12, SEQ ID NO: 14, SEQ ID NO: 16, SEQ ID NO: 18, SEQ ID NO: 20, SEQ ID NO: 22, SEQ ID NO: 24, SEQ ID NO: 26 or SEQ ID NO: 28 and their homologs. Any match in peptide sequences indicates the potential of having the homologous proteins in the samples. Additional techniques (protein purification and molecular biology) can be used to isolate the protein and identify the sequences of the homologs.

In hybridization methods, all or part of the pesticidal nucleic acid sequence can be used to screen cDNA or genomic libraries. Methods for construction of such cDNA and genomic libraries are generally known in the art and are disclosed in Sambrook and Russell, (2001), supra. The so-called hybridization probes may be genomic DNA fragments, cDNA fragments, RNA fragments or other oligonucleotides and may be labeled with a detectable group such as 32P or any other detectable marker, such as other radioisotopes, a fluorescent compound, an enzyme or an enzyme co-factor. Probes for hybridization can be made by labeling synthetic oligonucleotides based on the known IPD090 polypeptide-encoding nucleic acid sequence disclosed herein. Degenerate primers designed on the basis of conserved nucleotides or amino acid residues in the nucleic acid sequence or encoded amino acid sequence can additionally be used. The probe typically comprises a region of nucleic acid sequence that hybridizes under stringent conditions to at least about 12, at least about 25, at least about 50, 75, 100, 125, 150, 175 or 200 consecutive nucleotides of nucleic acid sequence encoding an IPD090 polypeptide of the disclosure or a fragment or variant thereof. Methods for the preparation of probes for hybridization are generally known in the art and are disclosed in Sambrook and Russell, (2001), supra, herein incorporated by reference.

For example, an entire nucleic acid sequence, encoding an IPD090 polypeptide, disclosed herein or one or more portions thereof may be used as a probe capable of specifically hybridizing to corresponding nucleic acid sequences encoding IPD090 polypeptide-like sequences and messenger RNAs. To achieve specific hybridization under a variety of conditions, such probes include sequences that are unique and are preferably at least about 10 nucleotides in length or at least about 20 nucleotides in length. Such probes may be used to amplify corresponding pesticidal sequences from a chosen organism by PCR. This technique may be used to isolate additional coding sequences from a desired organism or as a diagnostic assay to determine the presence of coding sequences in an organism. Hybridization techniques include hybridization screening of plated DNA libraries (either plaques or colonies; see, for example, Sambrook, et al., (1989) Molecular Cloning: A Laboratory Manual (2d ed., Cold Spring Harbor Laboratory Press, Cold Spring Harbor, N.Y.).

Hybridization of such sequences may be carried out under stringent conditions. "Stringent conditions" or "stringent hybridization conditions" is used herein to refer to conditions under which a probe will hybridize to its target sequence to a detectably greater degree than to other sequences (e.g., at least 2-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of similarity are detected (heterologous probing). Generally, a probe is less than about 1000 nucleotides in length, preferably less than 500 nucleotides in length Compositions Compositions comprising at least one IPD090 polypeptide or IPD090 chimeric polypeptide of the disclosure are also embraced. In one embodiment the composition comprises an IPD090 polypeptide of the disclosure and an agriculturally accepted carrier.

One embodiment of the disclosure relates to a composition comprising an IPD090 polypeptide of the discloser and an entomopathogenic fungal strain selected from *Metarhizium robertsii* and *Metarhizium anisopliae*. In certain embodiments, the fungal entomopathogen comprises a spore, a microsclerotia, or a conidia. In some embodiments, a fungal entomopathogen has insecticidal activity.

In one embodiment, the disclosure relates to a composition for increasing resistance to a plant pest, pathogen, or insect or for increasing plant health and/or yield comprising an IPD090 polypeptide of the discloser and one or more entomopathogenic fungal strains selected from the group consisting of *Metarhizium anisopliae* 15013-1 (NRRL 67073), *Metarhizium robertsii* 23013-3 (NRRL 67075), *Metarhizium anisopliae* 3213-1 (NRRL 67074), or any combinations thereof. In another embodiment, the disclosure relates to a composition comprising an IPD090 polypeptide of the discloser, an agriculturally accepted carrier, and a fungal entomopathogen selected from the group consisting of *Metarhizium anisopliae* 15013-1, *Metarhizium robertsii* 23013-3, *Metarhizium anisopliae* 3213-1, or any combinations thereof. In a further embodiment, the fungal entomopathogen comprises a spore, conidia, or microsclerotia. In another embodiment, the disclosure relates to a composition comprising an IPD090 polypeptide of the discloser and one or more entomopathogenic fungal strains selected from the group consisting of *Metarhizium anisopliae* 15013-1 (NRRL 67073), *Metarhizium robertsii* 23013-3 (NRRL 67075), *Metarhizium anisopliae* 3213-1 (NRRL 67074), mutants of these strains, a metabolite or combination of metabolites produced by a strain disclosed herein that exhibits insecticidal activity towards a plant pest, pathogen or insect, or any combinations thereof.

Antibodies

Antibodies to an IPD090 polypeptide of the embodiments or to variants or fragments thereof are also encompassed. The antibodies of the disclosure include polyclonal and monoclonal antibodies as well as fragments thereof which retain their ability to bind to an IPD090 polypeptide found in the insect gut. An antibody, monoclonal antibody or fragment thereof is said to be capable of binding a molecule if it is capable of specifically reacting with the molecule to thereby bind the molecule to the antibody, monoclonal antibody or fragment thereof. The term "antibody" (Ab) or "monoclonal antibody" (Mab) is meant to include intact molecules as well as fragments or binding regions or domains thereof (such as, for example, Fab and F(ab).sub.2 fragments) which are capable of binding hapten. Such fragments are typically produced by proteolytic cleavage, such as papain or pepsin. Alternatively, hapten-binding fragments can be produced through the application of recombinant DNA technology or through synthetic chemistry. Methods for the preparation of the antibodies of the present disclosure are generally known in the art. For example, see, Antibodies, A Laboratory Manual, Ed Harlow and David Lane (eds.) Cold Spring Harbor Laboratory, N.Y. (1988), as well as the references cited therein. Standard reference works setting forth the general principles of immunology include: Klein, J. Immunology: The Science of Cell-Noncell Discrimination, John Wiley & Sons, N.Y. (1982); Dennett, et al., Monoclonal Antibodies, Hybridoma: A New Dimension in Biological Analyses, Plenum Press, N.Y. (1980) and Campbell, "Monoclonal Antibody Technology," In Laboratory Techniques in Biochemistry and Molecular Biology, Vol. 13, Burdon, et al., (eds.), Elsevier, Amsterdam (1984). See also, U.S. Pat. Nos. 4,196,265; 4,609,893; 4,713,325; 4,714,681; 4,716,111; 4,716,117 and 4,720,459. Antibodies against IPD090 polypeptides or antigen-binding portions thereof can be produced by a variety of techniques, including conventional monoclonal antibody methodology, for example the standard somatic cell hybridization technique of Kohler and Milstein, (1975) Nature 256:495. Other techniques for producing monoclonal antibody can also be employed such as viral or oncogenic transformation of B lymphocytes. An animal system for preparing hybridomas is a murine system. Immunization protocols and techniques for isolation of immunized splenocytes for fusion are known in the art. Fusion partners (e.g., murine myeloma cells) and fusion procedures are also known. The antibody and monoclonal antibodies of the disclosure can be prepared by utilizing an IPD090 polypeptide as antigens.

A kit for detecting the presence of an IPD090 polypeptide or detecting the presence of a nucleotide sequence encoding an IPD090 polypeptide in a sample is provided. In one embodiment, the kit provides antibody-based reagents for detecting the presence of an IPD090 polypeptide in a tissue sample. In another embodiment, the kit provides labeled nucleic acid probes useful for detecting the presence of one or more polynucleotides encoding an IPD090 polypeptide. The kit is provided along with appropriate reagents and controls for carrying out a detection method, as well as instructions for use of the kit.

Receptor Identification and Isolation

Receptors to the IPD090 polypeptide of the embodiments or to variants or fragments thereof are also encompassed. Methods for identifying receptors are well known in the art (see, Hofmann, et. al., (1988) *Eur. J. Biochem.* 173:85-91; Gill, et al., (1995) *J. Biol. Chem.* 27277-27282) can be employed to identify and isolate the receptor that recognizes the IPD090 polypeptide using the brush-border membrane vesicles from susceptible insects. In addition to the radioactive labeling method listed in the cited literatures, an IPD090 polypeptide can be labeled with fluorescent dye and other common labels such as streptavidin. Brush-border membrane vesicles (BBMV) of susceptible insects such as soybean looper and stink bugs can be prepared according to the protocols listed in the references and separated on SDS-PAGE gel and blotted on suitable membrane. Labeled IPD090 polypeptide can be incubated with blotted membrane of BBMV and labeled IPD090 polypeptide can be identified with the labeled reporters. Identification of protein band(s) that interact with the IPD090 polypeptide can be detected by N-terminal amino acid gas phase sequencing or mass spectrometry based protein identification method (Patterson, (1998) 10.22, 1-24, Current Protocol in Molecular Biology published by John Wiley & Son Inc). Once the protein is identified, the corresponding gene can be cloned from genomic DNA or cDNA library of the susceptible insects and binding affinity can be measured directly with the IPD090 polypeptide. Receptor function for insecticidal activity by the IPD090 polypeptide can be verified by accomplished by RNAi type of gene knock out method (Rajagopal, et al., (2002) *J. Biol. Chem.* 277:46849-46851).

Nucleotide Constructs, Expression Cassettes and Vectors

The use of the term "nucleotide constructs" herein is not intended to limit the embodiments to nucleotide constructs comprising DNA. Those of ordinary skill in the art will recognize that nucleotide constructs particularly polynucleotides and oligonucleotides composed of ribonucleotides and combinations of ribonucleotides and deoxyribonucleotides may also be employed in the methods disclosed herein. The nucleotide constructs, nucleic acids, and nucleotide sequences of the embodiments additionally encompass all complementary forms of such constructs, molecules, and sequences. Further, the nucleotide constructs, nucleotide molecules, and nucleotide sequences of the embodiments encompass all nucleotide constructs, molecules, and sequences which can be employed in the methods of the embodiments for transforming plants including, but not limited to, those comprised of deoxyribonucleotides, ribonucleotides, and combinations thereof. Such deoxyribonucleotides and ribonucleotides include both naturally occurring molecules and synthetic analogues. The nucleotide constructs, nucleic acids, and nucleotide sequences of the embodiments also encompass all forms of nucleotide constructs including, but not limited to, single-stranded forms, double-stranded forms, hairpins, stem-and-loop structures and the like.

A further embodiment relates to a transformed organism such as an organism selected from plant and insect cells, bacteria, yeast, baculovirus, protozoa, nematodes and algae. The transformed organism comprises a DNA molecule of the embodiments, an expression cassette comprising the DNA molecule or a vector comprising the expression cassette, which may be stably incorporated into the genome of the transformed organism.

The sequences of the embodiments are provided in DNA constructs for expression in the organism of interest. The construct will include 5' and 3' regulatory sequences operably linked to a sequence of the embodiments. The term "operably linked" as used herein refers to a functional linkage between a promoter and a second sequence, wherein the promoter sequence initiates and mediates transcription of the DNA sequence corresponding to the second sequence. Generally, operably linked means that the nucleic acid sequences being linked are contiguous and where necessary to join two protein coding regions in the same reading frame. The construct may additionally contain at least one additional gene to be cotransformed into the organism. Alternatively, the additional gene(s) can be provided on multiple DNA constructs.

Such a DNA construct is provided with a plurality of restriction sites for insertion of the IPD090 polypeptide gene sequence of the disclosure to be under the transcriptional regulation of the regulatory regions. The DNA construct may additionally contain selectable marker genes.

The DNA construct will generally include in the 5' to 3' direction of transcription: a transcriptional and translational initiation region (i.e., a promoter), a DNA sequence of the embodiments, and a transcriptional and translational termination region (i.e., termination region) functional in the organism serving as a host. The transcriptional initiation region (i.e., the promoter) may be native, analogous, foreign or heterologous to the host organism and/or to the sequence of the embodiments. Additionally, the promoter may be the natural sequence or alternatively a synthetic sequence. The term "foreign" as used herein indicates that the promoter is not found in the native organism into which the promoter is introduced. Where the promoter is "foreign" or "heterologous" to the sequence of the embodiments, it is intended that the promoter is not the native or naturally occurring promoter for the operably linked sequence of the embodiments. As used herein, a chimeric gene comprises a coding sequence operably linked to a transcription initiation region that is heterologous to the coding sequence. Where the promoter is a native or natural sequence, the expression of the operably linked sequence is altered from the wild-type expression, which results in an alteration in phenotype.

In some embodiments the DNA construct comprises a polynucleotide encoding an IPD090 polypeptide of the embodiments.

In some embodiments the DNA construct comprises a polynucleotide encoding a chimeric IPD090 polypeptide of the embodiments.

In some embodiments the DNA construct comprises a polynucleotide encoding a fusion protein comprising an IPD090 polypeptide of the embodiments.

In some embodiments the DNA construct comprises a polynucleotide comprising a first coding sequence encoding the N-terminal Region of a first IPD090 polypeptide of the disclosure and a second coding sequence encoding the C-terminal Region of a second IPD090 polypeptide of the disclosure.

In some embodiments the DNA construct comprises a polynucleotide encoding the polypeptide of SEQ ID NO: 385, SEQ ID NO: 386, SEQ ID NO: 387 or SEQ ID NO: 388. In some embodiments the DNA construct comprises a polynucleotide of SEQ ID NO: 381, SEQ ID NO: 382 or SEQ ID NO: 383.

In some embodiments the DNA construct may also include a transcriptional enhancer sequence. As used herein, the term an "enhancer" refers to a DNA sequence which can stimulate promoter activity, and may be an innate element of the promoter or a heterologous element inserted to enhance the level or tissue-specificity of a promoter. Various enhancers are known in the art including for example, introns with gene expression enhancing properties in plants (US Patent Application Publication Number 2009/0144863, the ubiquitin intron (i.e., the maize ubiquitin intron 1 (see, for example, NCBI sequence S94464)), the omega enhancer or the omega prime enhancer (Gallie, et al., (1989) *Molecular Biology of RNA ed. Cech* (*Liss*, New York) 237-256 and Gallie, et al., (1987) *Gene* 60:217-25), the CaMV 35S enhancer (see, e.g., Benfey, et al., (1990) *EMBO J.* 9:1685-96) and the enhancers of U.S. Pat. No. 7,803,992 may also be used, each of which is incorporated by reference. U.S. Pat. No. 8,785,612 discloses the sugarcane bacilliform badnavirus (SCBV) transcriptional enhancer. The above list of transcriptional enhancers is not meant to be limiting. Any appropriate transcriptional enhancer can be used in the embodiments.

The termination region may be native with the transcriptional initiation region, may be native with the operably linked DNA sequence of interest, may be native with the plant host or may be derived from another source (i.e., foreign or heterologous to the promoter, the sequence of interest, the plant host or any combination thereof).

Convenient termination regions are available from the Ti-plasmid of *A. tumefaciens*, such as the octopine synthase and nopaline synthase termination regions. See also, Guerineau, et al., (1991) *Mol. Gen. Genet.* 262:141-144; Proudfoot, (1991) *Cell* 64:671-674; Sanfacon, et al., (1991) *Genes Dev.* 5:141-149; Mogen, et al., (1990) *Plant Cell* 2:1261-1272; Munroe, et al., (1990) *Gene* 91:151-158; Ballas, et al., (1989) *Nucleic Acids Res.* 17:7891-7903 and Joshi, et al., (1987) *Nucleic Acid Res.* 15:9627-9639. Other useful transcription terminators for expression of transgenes in plants include the transcription terminators MYB2, KTI1, PIP1, EF1A2, and MTH1 of U.S. Pat. No. 8,741,634.

Where appropriate, a nucleic acid may be optimized for increased expression in the host organism. Thus, where the host organism is a plant, the synthetic nucleic acids can be synthesized using plant-preferred codons for improved expression. See, for example, Campbell and Gowri, (1990) *Plant Physiol.* 92:1-11 for a discussion of host-preferred usage. For example, although nucleic acid sequences of the embodiments may be expressed in both monocotyledonous and dicotyledonous plant species, sequences can be modified to account for the specific preferences and GC content preferences of monocotyledons or dicotyledons as these preferences have been shown to differ (Murray et al. (1989) *Nucleic Acids Res.* 17:477-498). Thus, the maize-preferred for a particular amino acid may be derived from known gene sequences from maize. Maize usage for 28 genes from maize plants is listed in Table 4 of Murray, et al., supra. Methods are available in the art for synthesizing plant-preferred genes. See, for example, Murray, et al., (1989) *Nucleic Acids Res.* 17:477-498, and Liu H et al. *Mol Bio Rep* 37:677-684, 2010, herein incorporated by reference. A *Zea* maize usage table can be also found at kazusa.or.jp//cgi-bin/show.cgi?species=4577, which can be accessed using the www prefix.

A *Glycine max* usage table can be found at kazusa.or.jp//cgi-bin/show.cgi?species=3847&aa=1&style=N, which can be accessed using the www prefix.

In some embodiments the recombinant nucleic acid molecule encoding an IPD090 polypeptide has maize optimized codons.

Additional sequence modifications are known to enhance gene expression in a cellular host. These include elimination of sequences encoding spurious polyadenylation signals, exon-intron splice site signals, transposon-like repeats, and other well-characterized sequences that may be deleterious to gene expression. The GC content of the sequence may be adjusted to levels average for a given cellular host, as calculated by reference to known genes expressed in the host cell. The term "host cell" as used herein refers to a cell which contains a vector and supports the replication and/or expression of the expression vector is intended. Host cells may be prokaryotic cells such as *E. coli* or eukaryotic cells such as yeast, insect, amphibian or mammalian cells or monocotyledonous or dicotyledonous plant cells. An example of a monocotyledonous host cell is a maize host cell. When possible, the sequence is modified to avoid predicted hairpin secondary mRNA structures.

The expression cassettes may additionally contain 5' leader sequences. Such leader sequences can act to enhance translation. Translation leaders are known in the art and include: picornavirus leaders, for example, EMCV leader (Encephalomyocarditis 5' noncoding region) (Elroy-Stein, et al., (1989) *Proc. Natl. Acad. Sci. USA* 86:6126-6130); potyvirus leaders, for example, TEV leader (Tobacco Etch Virus) (Gallie, et al., (1995) *Gene* 165(2):233-238), MDMV leader (Maize Dwarf Mosaic Virus), human immunoglobulin heavy-chain binding protein (BiP) (Macejak, et al., (1991) *Nature* 353:90-94); untranslated leader from the coat protein mRNA of alfalfa mosaic virus (AMV RNA 4) (Jobling, et al., (1987) *Nature* 325:622-625); tobacco mosaic virus leader (TMV) (Gallie, et al., (1989) in *Molecular Biology of RNA*, ed. Cech (*Liss*, New York), pp. 237-256) and maize chlorotic mottle virus leader (MCMV) (Lommel, et al., (1991) *Virology* 81:382-385). See also, Della-Cioppa, et al., (1987) *Plant Physiol.* 84:965-968. Such constructs may also contain a "signal sequence" or "leader sequence" to facilitate cotranslational or post-translational transport of the peptide to certain intracellular structures such as the chloroplast (or other plastid), endoplasmic reticulum or Golgi apparatus.

"Signal sequence" as used herein refers to a sequence that is known or suspected to result in cotranslational or post-translational peptide transport across the cell membrane. In eukaryotes, this typically involves secretion into the Golgi apparatus, with some resulting glycosylation. Insecticidal toxins of bacteria are often synthesized as protoxins, which are proteolytically activated in the gut of the target pest (Chang, (1987) *Methods Enzymol.* 153:507-516). In some embodiments, the signal sequence is located in the native sequence or may be derived from a sequence of the embodiments. "Leader sequence" as used herein refers to any sequence that when translated, results in an amino acid sequence sufficient to trigger cotranslational transport of the peptide chain to a subcellular organelle. Thus, this includes leader sequences targeting transport and/or glycosylation by passage into the endoplasmic reticulum, passage to vacuoles, plastids including chloroplasts, mitochondria, and the like. Nuclear-encoded proteins targeted to the chloroplast thylakoid lumen compartment have a characteristic bipartite transit peptide, composed of a stromal targeting signal peptide and a lumen targeting signal peptide. The stromal targeting information is in the amino-proximal portion of the transit peptide. The lumen targeting signal peptide is in the carboxyl-proximal portion of the transit peptide, and contains all the information for targeting to the lumen. Recent research in proteomics of the higher plant chloroplast has achieved in the identification of numerous nuclear-encoded lumen proteins (Kieselbach et al. *FEBS LETT* 480:271-276, 2000; Peltier et al. Plant Cell 12:319-341, 2000; Bricker et al. *Biochim. Biophys Acta* 1503:350-356, 2001), the lumen targeting signal peptide of which can potentially be used in accordance with the present disclosure. About 80 proteins from *Arabidopsis*, as well as homologous proteins from spinach and garden pea, are reported by Kieselbach et al., *Photosynthesis Research,* 78:249-264, 2003. In particular, Table 2 of this publication, which is incorporated into the description herewith by reference, discloses 85 proteins from the chloroplast lumen, identified by their accession number (see also US Patent Application Publication 2009/09044298). In addition, the recently published draft version of the rice genome (Goff et al, *Science* 296:92-100, 2002) is a suitable source for lumen targeting signal peptide which may be used in accordance with the present disclosure.

Suitable chloroplast transit peptides (CTP) are well known to one skilled in the art also include chimeric CT's comprising but not limited to: an N-terminal domain, a central domain or a C-terminal domain from a CTP from *Oryza sativa* 1-decoy-D xylose-5-Phosphate Synthase *Oryza sativa*-Superoxide dismutase *Oryza sativa*-soluble starch synthase *Oryza sativa*-NADP-dependent Malic acid enzyme *Oryza sativa*-Phospho-2-dehydro-3-deoxyheptonate Aldolase 2 *Oryza sativa*-L-Ascorbate peroxidase 5 *Oryza sativa*-Phosphoglucan water dikinase, *Zea Mays* ssRUBISCO, *Zea Mays*-beta-glucosidase, *Zea Mays*-Malate dehydrogenase, *Zea Mays* Thioredoxin M-type (U.S. Pat. No. 9,150,625); a chloroplast transit peptide of US Patent Application Publication Number US20130210114.

The IPD090 polypeptide gene to be targeted to the chloroplast may be optimized for expression in the chloroplast to account for differences in usage between the plant nucleus and this organelle. In this manner, the nucleic acids of interest may be synthesized using chloroplast-preferred sequences.

In preparing the expression cassette, the various DNA fragments may be manipulated so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites or the like. For this purpose, in vitro mutagenesis, primer repair, restriction, annealing, resubstitutions, e.g., transitions and transversions, may be involved.

A number of promoters can be used in the practice of the embodiments. The promoters can be selected based on the desired outcome. The nucleic acids can be combined with constitutive, tissue-preferred, inducible or other promoters for expression in the host organism. Suitable constitutive promoters for use in a plant host cell include, for example, the core promoter of the Rsyn7 promoter and other constitutive promoters disclosed in WO 1999/43838 and U.S. Pat. No. 6,072,050; the core CaMV 35S promoter (Odell, et al., (1985) *Nature* 313:810-812); rice actin (McElroy, et al., (1990) *Plant Cell* 2:163-171); ubiquitin (Christensen, et al., (1989) *Plant Mol. Biol.* 12:619-632 and Christensen, et al., (1992) *Plant Mol. Biol.* 18:675-689); pEMU (Last, et al., (1991) *Theor. Appl. Genet.* 81:581-588); MAS (Velten, et al., (1984) *EMBO J.* 3:2723-2730), U.S. Pat. Nos. 8,168,859, 8,420,797; Ubiquitin transcriptional regulatory elements and transcriptional regulatory expression element group are disclosed in U.S. Pat. No. 9,062,316; ALS promoter (U.S. Pat. No. 5,659,026) and the like. The Soybean ADF1 constitutive promoter is disclosed in US Patent Application Publication US20150184174. The Soybean CCP1 constitutive promoter is disclosed in US Patent Application Publication US20150167011. Other constitutive promoters include, for example, those discussed in U.S. Pat. Nos. 5,608,149; 5,608,144; 5,604,121; 5,569,597; 5,466,785; 5,399,680; 5,268,463; 5,608,142 and 6,177,611. Transcriptional initiation regions isolated from a blueberry red ringspot virus (BRRV) are disclosed in US Patent U.S. Pat. No. 8,895,716. Transcriptional initiation regions isolated from a cacao swollen shoot virus (CSSV) are disclosed in US Patent U.S. Pat. No. 8,962,916.

Depending on the desired outcome, it may be beneficial to express the gene from an inducible promoter. Of particular interest for regulating the expression of the nucleotide sequences of the embodiments in plants are wound-inducible promoters. Such wound-inducible promoters, may respond to damage caused by insect feeding, and include potato proteinase inhibitor (pin II) gene (Ryan, (1990) *Ann. Rev. Phytopath.* 28:425-449; Duan, et al., (1996) *Nature Biotechnology* 14:494-498); wun1 and wun2, U.S. Pat. No. 5,428,148; win1 and win2 (Stanford, et al., (1989) *Mol. Gen. Genet.* 215:200-208); systemin (McGurl, et al., (1992) *Science* 225:1570-1573); WIP1 (Rohmeier, et al., (1993) *Plant Mol. Biol.* 22:783-792; Eckelkamp, et al., (1993) *FEBS Letters* 323:73-76); MPI gene (Corderok, et al., (1994) *Plant J.* 6(2):141-150) and the like, herein incorporated by reference.

Additionally, pathogen-inducible promoters may be employed in the methods and nucleotide constructs of the embodiments. Such pathogen-inducible promoters include those from pathogenesis-related proteins (PR proteins), which are induced following infection by a pathogen; e.g., PR proteins, SAR proteins, beta-1,3-glucanase, chitinase, etc. See, for example, Redolfi, et al., (1983) *Neth. J. Plant Pathol.* 89:245-254; Uknes, et al., (1992) *Plant Cell* 4: 645-656 and Van Loon, (1985) *Plant Mol. Virol.* 4:111-116. See also, WO 1999/43819, herein incorporated by reference.

Of interest are promoters that are expressed locally at or near the site of pathogen infection. See, for example, Marineau, et al., (1987) *Plant Mol. Biol.* 9:335-342; Matton, et al., (1989) *Molecular Plant-Microbe Interactions* 2:325-331; Somsisch, et al., (1986) *Proc. Natl. Acad. Sci. USA* 83:2427-2430; Somsisch, et al., (1988) *Mol. Gen. Genet.* 2:93-98 and Yang, (1996) *Proc. Natl. Acad. Sci. USA* 93:14972-14977. See also, Chen, et al., (1996) *Plant J.* 10:955-966; Zhang, et al., (1994) *Proc. Natl. Acad. Sci. USA* 91:2507-2511; Warner, et al., (1993) *Plant J.* 3:191-201; Siebertz, et al., (1989) *Plant Cell* 1:961-968; U.S. Pat. No. 5,750,386 (nematode-inducible) and the references cited therein. Of particular interest is the inducible promoter for the maize PRms gene, whose expression is induced by the pathogen *Fusarium moniliforme* (see, for example, Cordero, et al., (1992) *Physiol. Mol. Plant Path.* 41:189-200).

Chemical-regulated promoters can be used to modulate the expression of a gene in a plant through the application of an exogenous chemical regulator. Depending upon the objective, the promoter may be a chemical-inducible promoter, where application of the chemical induces gene expression or a chemical-repressible promoter, where application of the chemical represses gene expression. Chemical-inducible promoters are known in the art and include, but are not limited to, the maize In2-2 promoter, which is activated by benzenesulfonamide herbicide safeners, the maize GST promoter, which is activated by hydrophobic electrophilic compounds that are used as pre-emergent herbicides, and the tobacco PR-1a promoter, which is activated by salicylic acid. Other chemical-regulated promoters of interest include steroid-responsive promoters (see, for example, the glucocorticoid-inducible promoter in Schena, et al., (1991) *Proc. Natl. Acad. Sci. USA* 88:10421-10425 and McNellis, et al., (1998) *Plant J.* 14(2):247-257) and tetracycline-inducible and tetracycline-repressible promoters (see, for example, Gatz, et al., (1991) *Mol. Gen. Genet.* 227:229-237 and U.S. Pat. Nos. 5,814,618 and 5,789,156), herein incorporated by reference.

Tissue-preferred promoters can be utilized to target enhanced an IPD090 polypeptide expression within a particular plant tissue. Tissue-preferred promoters include those discussed in Yamamoto, et al., (1997) *Plant J.* 12(2)255-265; Kawamata, et al., (1997) *Plant Cell Physiol.* 38(7): 792-803; Hansen, et al., (1997) *Mol. Gen Genet.* 254(3): 337-343; Russell, et al., (1997) *Transgenic Res.* 6(2):157-168; Rinehart, et al., (1996) *Plant Physiol.* 112(3):1331-1341; Van Camp, et al., (1996) *Plant Physiol.* 112(2):525-535; Canevascini, et al., (1996) *Plant Physiol.* 112(2):513-524; Yamamoto, et al., (1994) *Plant Cell Physiol.* 35(5): 773-778; Lam, (1994) *Results Probl. Cell Differ.* 20:181-196; Orozco, et al., (1993) *Plant Mol Biol.* 23(6):1129-1138; Matsuoka, et al., (1993) *Proc Natl. Acad. Sci. USA* 90(20): 9586-9590 and Guevara-Garcia, et al., (1993) *Plant J.* 4(3):495-505. Additional tissue specific promoters are known in the art including the promoters of US Patent Numbers U.S. Pat. Nos. 8,816,152 and 9,150,624. Such promoters can be modified, if necessary, for weak expression.

Leaf-preferred promoters are known in the art. See, for example, Yamamoto, et al., (1997) *Plant J.* 12(2):255-265; Kwon, et al., (1994) *Plant Physiol.* 105:357-67; Yamamoto, et al., (1994) *Plant Cell Physiol.* 35(5):773-778; Gotor, et al., (1993) *Plant J.* 3:509-18; Orozco, et al., (1993) *Plant Mol. Biol.* 23(6):1129-1138 and Matsuoka, et al., (1993) *Proc. Natl. Acad. Sci. USA* 90(20):9586-9590.

US Patent Application-preferred or root-specific promoters are known and can be selected from the many available from the literature or isolated de novo from various compatible species. See, for example, Hire, et al., (1992) *Plant Mol. Biol.* 20(2):207-218 (soybean root-specific glutamine synthetase gene); Keller and Baumgartner, (1991) *Plant Cell* 3(10):1051-1061 (root-specific control element in the GRP 1.8 gene of French bean); Sanger, et al., (1990) *Plant Mol. Biol.* 14(3):433-443 (root-specific promoter of the mannopine synthase (MAS) gene of *Agrobacterium tumefaciens*) and Miao, et al., (1991) *Plant Cell* 3(1):11-22 (full-length cDNA clone encoding cytosolic glutamine synthetase (GS), which is expressed in roots and root nodules of soybean). See also, Bogusz, et al., (1990) *Plant Cell* 2(7): 633-641, where two root-specific promoters isolated from hemoglobin genes from the nitrogen-fixing nonlegume *Parasponia andersonii* and the related non-nitrogen-fixing nonlegume *Trema tomentosa* are described. The promoters of these genes were linked to a β-glucuronidase reporter gene and introduced into both the nonlegume *Nicotiana tabacum* and the legume *Lotus corniculatus*, and in both instances root-specific promoter activity was preserved. Leach and Aoyagi, (1991) describe their analysis of the promoters of the highly expressed rolC and rolD root-inducing genes of *Agrobacterium rhizogenes* (see, Plant Science (Limerick) 79(1):69-76). They concluded that enhancer and tissue-preferred DNA determinants are dissociated in those promoters. Teeri, et al., (1989) used gene fusion to lacZ to show that the *Agrobacterium* T-DNA gene encoding octopine synthase is especially active in the epidermis of the root tip and that the TR2' gene is root specific in the intact plant and stimulated by wounding in leaf tissue, an especially desirable combination of characteristics for use with an insecticidal or larvicidal gene (see, *EMBO J.* 8(2): 343-350). The TR1' gene fused to nptII (neomycin phosphotransferase II) showed similar characteristics. Additional root-preferred promoters include the VfENOD-GRP3 gene promoter (Kuster, et al., (1995) *Plant Mol. Biol.* 29(4):759-772) and rolB promoter (Capana, et al., (1994) *Plant Mol. Biol.* 25(4):681-691. See also, U.S. Pat. Nos. 5,837,876; 5,750,386; 5,633,363; 5,459,252; 5,401,836; 5,110,732 and 5,023,179. *Arabidopsis thaliana* root-preferred regulatory sequences are disclosed in US20130117883. US Patent Application Publication Number US20160097054 discloses the sorghum root-preferred promoter PLTP. US Patent Application Publication Number US20160145634 discloses the sorghum root-preferred promoter TIP2-3. U.S. Pat. No. 8,916,377 discloses the sorghum root-preferred promoter RCc3.

"Seed-preferred" promoters include both "seed-specific" promoters (those promoters active during seed development such as promoters of seed storage proteins) as well as "seed-germinating" promoters (those promoters active during seed germination). See, Thompson, et al., (1989) *BioEssays* 10:108, herein incorporated by reference. Such seed-preferred promoters include, but are not limited to, Cim1 (cytokinin-induced message); cZ19B1 (maize 19 kDa zein); and milps (myo-inositol-1-phosphate synthase) (see, U.S. Pat. No. 6,225,529, herein incorporated by reference). Gamma-zein and Glb-1 are endosperm-specific promoters. For dicots, seed-specific promoters include, but are not limited to, Kunitz trypsin inhibitor 3 (KTi3) (Jofuku and Goldberg, (1989) *Plant Cell* 1:1079-1093), bean β-phaseolin, napin, β-conglycinin, glycinin 1, soybean lectin, cruciferin, and the like. For monocots, seed-specific promoters include, but are not limited to, maize 15 kDa zein, 22 kDa zein, 27 kDa zein, g-zein, waxy, shrunken 1, shrunken 2, globulin 1, etc. See also, WO 2000/12733, where seed-preferred promoters from end1 and end2 genes are disclosed; herein incorporated by reference. In dicots, seed specific promoters include but are not limited to seed coat promoter from *Arabidopsis*, pBAN; and the early seed promoters from *Arabidopsis, p26, p63,* and p63tr (U.S. Pat. Nos. 7,294,760 and 7,847,153). A promoter that has "preferred" expression in a particular tissue is expressed in that tissue to a greater degree than in at least one other plant tissue. Some tissue-preferred promoters show expression almost exclusively in the particular tissue.

Where low level expression is desired, weak promoters will be used. Generally, the term "weak promoter" as used herein refers to a promoter that drives expression of a coding sequence at a low level. By low level expression at levels of between about 1/1000 transcripts to about 1/100,000 transcripts to about 1/500,000 transcripts is intended. Alternatively, it is recognized that the term "weak promoters" also encompasses promoters that drive expression in only a few cells and not in others to give a total low level of expression. Where a promoter drives expression at unacceptably high levels, portions of the promoter sequence can be deleted or modified to decrease expression levels.

Such weak constitutive promoters include, for example the core promoter of the Rsyn7 promoter (WO 1999/43838 and U.S. Pat. No. 6,072,050), the core 35S CaMV promoter, and the like. Other constitutive promoters include, for example, those disclosed in U.S. Pat. Nos. 5,608,149; 5,608,144; 5,604,121; 5,569,597; 5,466,785; 5,399,680; 5,268,463; 5,608,142, 6,177,611, and 8,697,857, herein incorporated by reference.

Chimeric or hybrid promoters are also known in art including those disclosed in US Patent Numbers U.S. Pat. Nos. 8,846,892, 8,822,666, and 9,181,560.

The above list of promoters is not meant to be limiting. Any appropriate promoter can be used in the embodiments.

Generally, the expression cassette will comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones and 2,4-dichlorophenoxyacetate (2,4-D). Additional examples of suitable selectable marker genes include, but are not limited to, genes encoding resistance to chloramphenicol (Herrera Estrella, et al., (1983) *EMBO J.* 2:987-992); methotrexate (Herrera Estrella, et al., (1983) *Nature* 303:209-213 and Meijer, et al., (1991) *Plant Mol. Biol.* 16:807-820); streptomycin (Jones, et al., (1987) *Mol. Gen. Genet.* 210:86-91); spectinomycin (Bretagne-Sagnard, et al., (1996) *Transgenic Res.* 5:131-137); bleomycin (Hille, et al., (1990) *Plant Mol. Biol.* 7:171-176); sulfonamide (Guerineau, et al., (1990) *Plant Mol. Biol.* 15:127-136); bromoxynil (Stalker, et al., (1988) *Science* 242:419-423); glyphosate (Shaw, et al., (1986) *Science* 233:478-481 and U.S. patent application Ser. Nos. 10/004,357 and 10/427,692); phosphinothricin (DeBlock, et al., (1987) *EMBO J.* 6:2513-2518). See generally, Yarranton, (1992) *Curr. Opin. Biotech.* 3:506-511; Christopherson, et al., (1992) *Proc. Natl. Acad. Sci. USA* 89:6314-6318; Yao, et al., (1992) *Cell* 71:63-72; Reznikoff, (1992) *Mol. Microbiol.* 6:2419-2422; Barkley, et al., (1980) in *The Operon*, pp. 177-220; Hu, et al., (1987) *Cell* 48:555-566; Brown, et al., (1987) *Cell* 49:603-612; Figge, et al., (1988) *Cell* 52:713-722; Deuschle, et al., (1989) *Proc. Natl. Acad. Sci. USA* 86:5400-5404; Fuerst, et al., (1989) *Proc. Natl. Acad. Sci. USA* 86:2549-2553; Deuschle, et al., (1990) *Science* 248:480-483; Gossen, (1993) Ph.D. Thesis, University of Heidelberg; Reines, et al., (1993) *Proc. Natl. Acad. Sci. USA* 90:1917-1921; Labow, et al., (1990) *Mol. Cell. Biol.* 10:3343-3356; Zambretti, et al., (1992) *Proc. Natl. Acad. Sci. USA* 89:3952-3956; Baim, et al., (1991) *Proc. Natl. Acad. Sci. USA* 88:5072-5076; Wyborski, et al., (1991) *Nucleic Acids Res.* 19:4647-4653; Hillenand-Wissman, (1989) *Topics Mol. Struc. Biol.* 10:143-162; Degenkolb, et al., (1991) *Antimicrob. Agents Chemother.* 35:1591-1595; Kleinschnidt, et al., (1988) *Biochemistry* 27:1094-1104; Bonin, (1993) Ph.D. Thesis, University of Heidelberg; Gossen, et al., (1992) *Proc. Natl. Acad. Sci. USA* 89:5547-5551; Oliva, et al., (1992) *Antimicrob. Agents Chemother.* 36:913-919; Hlavka, et al., (1985) *Handbook of Experimental Pharmacology*, Vol. 78 (Springer-Verlag, Berlin) and Gill, et al., (1988) *Nature* 334:721-724. Such disclosures are herein incorporated by reference.

The above list of selectable marker genes is not meant to be limiting. Any selectable marker gene can be used in the embodiments.

Plant Transformation

The methods of the embodiments involve introducing a polypeptide or polynucleotide into a plant. "Introducing" is as used herein means presenting to the plant the polynucleotide or polypeptide in such a manner that the sequence gains access to the interior of a cell of the plant. The methods of the embodiments do not depend on a particular method for introducing a polynucleotide or polypeptide into a plant, only that the polynucleotide or polypeptides gains access to the interior of at least one cell of the plant. Methods for introducing polynucleotide or polypeptides into plants are known in the art including, but not limited to, stable transformation methods, transient transformation methods, and virus-mediated methods.

"Stable transformation" is as used herein means that the nucleotide construct introduced into a plant integrates into the genome of the plant and is capable of being inherited by the progeny thereof. "Transient transformation" as used herein means that a polynucleotide is introduced into the plant and does not integrate into the genome of the plant or a polypeptide is introduced into a plant. "Plant" as used herein refers to whole plants, plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells and pollen).

Transformation protocols as well as protocols for introducing nucleotide sequences into plants may vary depending on the type of plant or plant cell, i.e., monocot or dicot, targeted for transformation. Suitable methods of introducing nucleotide sequences into plant cells and subsequent insertion into the plant genome include microinjection (Crossway, et al., (1986) *Biotechniques* 4:320-334), electroporation (Riggs, et al., (1986) *Proc. Natl. Acad. Sci. USA* 83:5602-5606), *Agrobacterium*-mediated transformation (U.S. Pat. Nos. 5,563,055 and 5,981,840), direct gene transfer (Paszkowski, et al., (1984) *EMBO J.* 3:2717-2722) and ballistic particle acceleration (see, for example, U.S. Pat. Nos. 4,945,050; 5,879,918; 5,886,244 and 5,932,782; Tomes, et al., (1995) in *Plant Cell, Tissue, and Organ Culture: Fundamental Methods*, ed. Gamborg and Phillips, (Springer-Verlag, Berlin) and McCabe, et al., (1988) *Biotechnology* 6:923-926) and Led transformation (WO 00/28058). For potato transformation see, Tu, et al., (1998) *Plant Molecular Biology* 37:829-838 and Chong, et al., (2000) *Transgenic Research* 9:71-78. Additional transformation procedures can be found in Weissinger, et al., (1988) *Ann. Rev. Genet.* 22:421-477; Sanford, et al., (1987) *Particulate Science and Technology* 5:27-37 (onion); Christou, et al., (1988) *Plant Physiol.* 87:671-674 (soybean); McCabe, et al., (1988) *Bio/Technology* 6:923-926 (soybean); Finer and McMullen, (1991) *In Vitro Cell Dev. Biol.* 27P:175-182 (soybean); Singh, et al., (1998) *Theor. Appl. Genet.* 96:319-324 (soybean); Datta, et al., (1990) *Biotechnology* 8:736-740 (rice); Klein, et al., (1988) *Proc. Natl. Acad. Sci. USA* 85:4305-4309 (maize); Klein, et al., (1988) *Biotechnology* 6:559-563 (maize); U.S. Pat. Nos. 5,240,855; 5,322,783 and 5,324,646; Klein, et al., (1988) *Plant Physiol.* 91:440-444 (maize); Fromm, et al., (1990) *Biotechnology* 8:833-839 (maize); Hooykaas-Van Slogteren, et al., (1984) *Nature* (London) 311:763-764; U.S. Pat. No. 5,736,369 (cereals); Bytebier, et al., (1987) *Proc. Natl. Acad. Sci. USA* 84:5345-5349 (Liliaceae); De Wet, et al., (1985) in *The Experimental Manipulation of Ovule Tissues*, ed. Chapman, et al., (Longman, New York), pp. 197-209 (pollen); Kaeppler, et al., (1990) *Plant Cell Reports* 9:415-418 and Kaeppler, et al., (1992) *Theor. Appl. Genet.* 84:560-566 (whisker-mediated transformation); D'Halluin, et al., (1992) *Plant Cell* 4:1495-1505 (electroporation); Li, et al., (1993) *Plant Cell Reports* 12:250-255 and Christou and Ford, (1995) *Annals of Botany* 75:407-413 (rice); Osjoda, et al., (1996) *Nature Biotechnology* 14:745-750 (maize via *Agrobacterium tumefaciens*); all of which are herein incorporated by reference.

In specific embodiments, the sequences of the embodiments can be provided to a plant using a variety of transient transformation methods. Such transient transformation methods include, but are not limited to, the introduction of the IPD090 polynucleotide or variants and fragments thereof directly into the plant or the introduction of the IPD090 polypeptide transcript into the plant. Such methods include, for example, microinjection or particle bombardment. See, for example, Crossway, et al., (1986) *Mol Gen. Genet.* 202:179-185; Nomura, et al., (1986) *Plant Sci.* 44:53-58; Hepler, et al., (1994) *Proc. Natl. Acad. Sci.* 91:2176-2180 and Hush, et al., (1994) *The Journal of Cell Science* 107: 775-784, all of which are herein incorporated by reference. Alternatively, the IPD090 polynucleotide can be transiently transformed into the plant using techniques known in the art. Such techniques include viral vector system and the precipitation of the polynucleotide in a manner that precludes subsequent release of the DNA. Thus, transcription from the particle-bound DNA can occur, but the frequency with which it is released to become integrated into the genome is greatly reduced. Such methods include the use of particles coated with polyethylimine (PEI; Sigma #P3143).

Methods are known in the art for the targeted insertion of a polynucleotide at a specific location in the plant genome. In one embodiment, the insertion of the polynucleotide at a desired genomic location is achieved using a site-specific recombination system. See, for example, WO 1999/25821, WO 1999/25854, WO 1999/25840, WO 1999/25855 and WO 1999/25853, all of which are herein incorporated by reference. Briefly, the polynucleotide of the embodiments can be contained in transfer cassette flanked by two non-identical recombination sites. The transfer cassette is introduced into a plant have stably incorporated into its genome a target site which is flanked by two non-identical recombination sites that correspond to the sites of the transfer cassette. An appropriate recombinase is provided and the transfer cassette is integrated at the target site. The polynucleotide of interest is thereby integrated at a specific chromosomal position in the plant genome.

Plant transformation vectors may be comprised of one or more DNA vectors needed for achieving plant transformation. For example, it is a common practice in the art to utilize plant transformation vectors that are comprised of more than one contiguous DNA segment. These vectors are often referred to in the art as "binary vectors". Binary vectors as well as vectors with helper plasmids are most often used for *Agrobacterium*-mediated transformation, where the size and complexity of DNA segments needed to achieve efficient transformation is quite large, and it is advantageous to separate functions onto separate DNA molecules. Binary vectors typically contain a plasmid vector that contains the cis-acting sequences required for T-DNA transfer (such as left border and right border), a selectable marker that is engineered to be capable of expression in a plant cell, and a "gene of interest" (a gene engineered to be capable of expression in a plant cell for which generation of transgenic plants is desired). Also present on this plasmid vector are sequences required for bacterial replication. The cis-acting sequences are arranged in a fashion to allow efficient transfer into plant cells and expression therein. For example, the selectable marker gene and the pesticidal gene are located between the left and right borders. Often a second plasmid vector contains the trans-acting factors that mediate T-DNA transfer from *Agrobacterium* to plant cells. This plasmid often contains the virulence functions (Vir genes) that allow infection of plant cells by *Agrobacterium*, and transfer of DNA by cleavage at border sequences and vir-mediated DNA transfer, as is understood in the art (Hellens and Mullineaux, (2000) *Trends in Plant Science* 5:446-451). Several types of *Agrobacterium* strains (e.g. LBA4404, GV3101, EHA101, EHA105, etc.) can be used for plant transformation. The second plasmid vector is not necessary for transforming the plants by other methods such as microprojection, microinjection, electroporation, polyethylene glycol, etc.

In general, plant transformation methods involve transferring heterologous DNA into target plant cells (e.g., immature or mature embryos, suspension cultures, undifferentiated callus, protoplasts, etc.), followed by applying a maximum threshold level of appropriate selection (depending on the selectable marker gene) to recover the transformed plant cells from a group of untransformed cell mass. Following integration of heterologous foreign DNA into plant cells, one then applies a maximum threshold level of appropriate selection in the medium to kill the untransformed cells and separate and proliferate the putatively transformed cells that survive from this selection treatment by transferring regularly to a fresh medium. By continuous passage and challenge with appropriate selection, one identifies and proliferates the cells that are transformed with the plasmid vector. Molecular and biochemical methods can then be used to confirm the presence of the integrated heterologous gene of interest into the genome of the transgenic plant.

Explants are typically transferred to a fresh supply of the same medium and cultured routinely. Subsequently, the transformed cells are differentiated into shoots after placing on regeneration medium supplemented with a maximum threshold level of selecting agent. The shoots are then transferred to a selective rooting medium for recovering rooted shoot or plantlet. The transgenic plantlet then grows into a mature plant and produces fertile seeds (e.g., Hiei, et al., (1994) *The Plant Journal* 6:271-282; Ishida, et al., (1996) *Nature Biotechnology* 14:745-750). Explants are typically transferred to a fresh supply of the same medium and cultured routinely. A general description of the techniques and methods for generating transgenic plants are found in Ayres and Park, (1994) *Critical Reviews in Plant Science* 13:219-239 and Bommineni and Jauhar, (1997) *Maydica* 42:107-120. Since the transformed material contains many cells; both transformed and non-transformed cells are present in any piece of subjected target callus or tissue or group of cells. The ability to kill non-transformed cells and allow transformed cells to proliferate results in transformed plant cultures. Often, the ability to remove non-transformed cells is a limitation to rapid recovery of transformed plant cells and successful generation of transgenic plants.

The cells that have been transformed may be grown into plants in accordance with conventional ways. See, for example, McCormick, et al., (1986) *Plant Cell Reports* 5:81-84. These plants may then be grown, and either pollinated with the same transformed strain or different strains, and the resulting hybrid having constitutive or inducible expression of the desired phenotypic characteristic identified. Two or more generations may be grown to ensure that expression of the desired phenotypic characteristic is stably maintained and inherited and then seeds harvested to ensure that expression of the desired phenotypic characteristic has been achieved.

The nucleotide sequences of the embodiments may be provided to the plant by contacting the plant with a virus or viral nucleic acids. Generally, such methods involve incorporating the nucleotide construct of interest within a viral DNA or RNA molecule. It is recognized that the recombinant proteins of the embodiments may be initially synthesized as part of a viral polyprotein, which later may be processed by proteolysis in vivo or in vitro to produce the desired IPD090 polypeptide. It is also recognized that such a viral polyprotein, comprising at least a portion of the amino acid sequence of an IPD090 of the embodiments, may have the desired pesticidal activity. Such viral polyproteins and the nucleotide sequences that encode for them are encompassed by the embodiments. Methods for providing plants with nucleotide constructs and producing the encoded proteins in the plants, which involve viral DNA or RNA molecules, are known in the art. See, for example, U.S. Pat. Nos. 5,889,191; 5,889,190; 5,866,785; 5,589,367 and 5,316,931; herein incorporated by reference.

Methods for transformation of chloroplasts are known in the art. See, for example, Svab, et al., (1990) *Proc. Natl. Acad. Sci. USA* 87:8526-8530; Svab and Maliga, (1993) *Proc. Natl. Acad. Sci. USA* 90:913-917; Svab and Maliga, (1993) *EMBO J.* 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride, et al., (1994) *Proc. Natl. Acad. Sci. USA* 91:7301-7305.

The embodiments further relate to plant-propagating material of a transformed plant of the embodiments including, but not limited to, seeds, tubers, corms, bulbs, leaves and cuttings of roots and shoots.

The embodiments may be used for transformation of any plant species, including, but not limited to, monocots and dicots. Examples of plants of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), *papaya* (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables ornamentals, and conifers.

Vegetables include tomatoes (*Lycopersicon esculentum*), lettuce (e.g., *Lactuca sativa*), green beans (*Phaseolus vulgaris*), lima beans (*Phaseolus limensis*), peas (*Lathyrus* spp.), and members of the genus *Cucumis* such as cucumber (*C. sativus*), cantaloupe (*C. cantalupensis*), and musk melon (*C. melo*). Ornamentals include azalea (*Rhododendron* spp.), *hydrangea* (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pul-

*cherrima*), and *chrysanthemum*. Conifers that may be employed in practicing the embodiments include, for example, pines such as loblolly pine (*Pinus taeda*), slash pine (*Pinus elliotii*), ponderosa pine (*Pinus ponderosa*), lodgepole pine (*Pinus contorta*), and Monterey pine (*Pinus radiata*); Douglas-fir (*Pseudotsuga menziesi*); Western hemlock (*Tsuga canadensis*); Sitka spruce (*Picea glauca*); redwood (*Sequoia sempervirens*); true firs such as silver fir (*Abies amabilis*) and balsam fir (*Abies balsamea*); and cedars such as Western red cedar (*Thuja plicata*) and Alaska yellow-cedar (*Chamaecyparis nootkatensis*). Plants of the embodiments include crop plants (for example, corn, alfalfa, sunflower, *Brassica*, soybean, cotton, safflower, peanut, sorghum, wheat, millet, tobacco, etc.), such as corn and soybean plants.

Turf grasses include, but are not limited to: annual bluegrass (*Poa annua*); annual ryegrass (*Lolium multiflorum*); Canada bluegrass (*Poa compressa*); Chewing's fescue (*Festuca rubra*); colonial bentgrass (*Agrostis tenuis*); creeping bentgrass (*Agrostis palustris*); crested wheatgrass (*Agropyron desertorum*); fairway wheatgrass (*Agropyron cristatum*); hard fescue (*Festuca longifolia*); Kentucky bluegrass (*Poa pratensis*); orchardgrass (*Dactylis glomerata*); perennial ryegrass (*Lolium perenne*); red fescue (*Festuca rubra*); redtop (*Agrostis alba*); rough bluegrass (*Poa trivialis*); sheep fescue (*Festuca ovina*); smooth bromegrass (*Bromus inermis*); tall fescue (*Festuca arundinacea*); timothy (*Phleum pratense*); velvet bentgrass (*Agrostis canina*); weeping alkaligrass (*Puccinellia distans*); western wheatgrass (*Agropyron smithii*); Bermuda grass (*Cynodon* spp.); St. Augustine grass (*Stenotaphrum secundatum*); zoysia grass (*Zoysia* spp.); Bahia grass (*Paspalum notatum*); carpet grass (*Axonopus affinis*); centipede grass (*Eremochloa ophiuroides*); kikuyu grass (*Pennisetum clandesinum*); seashore paspalum (*Paspalum vaginatum*); blue gramma (*Bouteloua gracilis*); buffalo grass (*Buchloe dactyloids*); sideoats gramma (*Bouteloua curtipendula*).

Plants of interest include grain plants that provide seeds of interest, oil-seed plants, and leguminous plants. Seeds of interest include grain seeds, such as corn, wheat, barley, rice, sorghum, rye, millet, etc. Oil-seed plants include cotton, soybean, safflower, sunflower, *Brassica*, maize, alfalfa, palm, coconut, flax, castor, olive, etc. Leguminous plants include beans and peas. Beans include guar, locust bean, fenugreek, soybean, garden beans, cowpea, mung bean, lima bean, fava bean, lentils, chickpea, etc.

Evaluation of Plant Transformation

Following introduction of heterologous foreign DNA into plant cells, the transformation or integration of heterologous gene in the plant genome is confirmed by various methods such as analysis of nucleic acids, proteins and metabolites associated with the integrated gene.

PCR analysis is a rapid method to screen transformed cells, tissue or shoots for the presence of incorporated gene at the earlier stage before transplanting into the soil (Sambrook and Russell, (2001) Molecular Cloning: A Laboratory Manual. Cold Spring Harbor Laboratory Press, Cold Spring Harbor, N.Y.). PCR is carried out using oligonucleotide primers specific to the gene of interest or *Agrobacterium* vector background, etc.

Plant transformation may be confirmed by Southern blot analysis of genomic DNA (Sambrook and Russell, (2001) supra). In general, total DNA is extracted from the transformant, digested with appropriate restriction enzymes, fractionated in an agarose gel and transferred to a nitrocellulose or nylon membrane. The membrane or "blot" is then probed with, for example, radiolabeled 32P target DNA fragment to confirm the integration of introduced gene into the plant genome according to standard techniques (Sambrook and Russell, (2001) supra).

In Northern blot analysis, RNA is isolated from specific tissues of transformant, fractionated in a formaldehyde agarose gel, and blotted onto a nylon filter according to standard procedures that are routinely used in the art (Sambrook and Russell, (2001) supra). Expression of RNA encoded by the pesticidal gene is then tested by hybridizing the filter to a radioactive probe derived from a pesticidal gene, by methods known in the art (Sambrook and Russell, (2001) supra).

Western blot, biochemical assays and the like may be carried out on the transgenic plants to confirm the presence of protein encoded by the pesticidal gene by standard procedures (Sambrook and Russell, 2001, supra) using antibodies that bind to one or more epitopes present on the IPD090 polypeptide.

Methods to Introduce Genome Editing Technologies into Plants

In some embodiments, the disclosed IPD090 polynucleotide compositions can be introduced into the genome of a plant using genome editing technologies, or previously introduced IPD090 polynucleotides in the genome of a plant may be edited using genome editing technologies. For example, the disclosed polynucleotides can be introduced into a desired location in the genome of a plant through the use of double-stranded break technologies such as TALENs, meganucleases, zinc finger nucleases, CRISPR-Cas, and the like. For example, the disclosed polynucleotides can be introduced into a desired location in a genome using a CRISPR-Cas system, for the purpose of site-specific insertion. The desired location in a plant genome can be any desired target site for insertion, such as a genomic region amenable for breeding or may be a target site located in a genomic window with an existing trait of interest. Existing traits of interest could be either an endogenous trait or a previously introduced trait.

In some embodiments, where the disclosed IPD090 polynucleotide has previously been introduced into a genome, genome editing technologies may be used to alter or modify the introduced polynucleotide sequence. Site specific modifications that can be introduced into the disclosed IPD090 polynucleotide compositions include those produced using any method for introducing site specific modification, including, but not limited to, through the use of gene repair oligonucleotides (e.g. US Publication 2013/0019349), or through the use of double-stranded break technologies such as TALENs, meganucleases, zinc finger nucleases, CRISPR-Cas, and the like. Such technologies can be used to modify the previously introduced polynucleotide through the insertion, deletion or substitution of nucleotides within the introduced polynucleotide. Alternatively, double-stranded break technologies can be used to add additional nucleotide sequences to the introduced polynucleotide. Additional sequences that may be added include, additional expression elements, such as enhancer and promoter sequences. In another embodiment, genome editing technologies may be used to position additional insecticidally-active proteins in close proximity to the disclosed IPD090 polynucleotide compositions disclosed herein within the genome of a plant, in order to generate molecular stacks of insecticidally-active proteins.

An "altered target site," "altered target sequence," "modified target site," and "modified target sequence" are used interchangeably herein and refer to a target sequence as disclosed herein that comprises at least one alteration when compared to non-altered target sequence. Such "alterations"

include, for example: (i) replacement of at least one nucleotide, (ii) a deletion of at least one nucleotide, (iii) an insertion of at least one nucleotide, or (iv) any combination of (i)-(iii).

Stacking of Traits in Transgenic Plant

Transgenic plants may comprise a stack of one or more insecticidal polynucleotides disclosed herein with one or more additional polynucleotides resulting in the production or suppression of multiple polypeptide sequences. Transgenic plants comprising stacks of polynucleotide sequences can be obtained by either or both of traditional breeding methods or through genetic engineering methods. These methods include, but are not limited to, breeding individual lines each comprising a polynucleotide of interest, transforming a transgenic plant comprising a gene disclosed herein with a subsequent gene and co-transformation of genes into a single plant cell. As used herein, the term "stacked" includes having the multiple traits present in the same plant (i.e., both traits are incorporated into the nuclear genome, one trait is incorporated into the nuclear genome and one trait is incorporated into the genome of a plastid or both traits are incorporated into the genome of a plastid). In one non-limiting example, "stacked traits" comprise a molecular stack where the sequences are physically adjacent to each other. A trait, as used herein, refers to the phenotype derived from a particular sequence or groups of sequences. Co-transformation of genes can be carried out using single transformation vectors comprising multiple genes or genes carried separately on multiple vectors. If the sequences are stacked by genetically transforming the plants, the polynucleotide sequences of interest can be combined at any time and in any order. The traits can be introduced simultaneously in a co-transformation protocol with the polynucleotides of interest provided by any combination of transformation cassettes. For example, if two sequences will be introduced, the two sequences can be contained in separate transformation cassettes (trans) or contained on the same transformation cassette (cis). Expression of the sequences can be driven by the same promoter or by different promoters. In certain cases, it may be desirable to introduce a transformation cassette that will suppress the expression of the polynucleotide of interest. This may be combined with any combination of other suppression cassettes or overexpression cassettes to generate the desired combination of traits in the plant. It is further recognized that polynucleotide sequences can be stacked at a desired genomic location using a site-specific recombination system. See, for example, WO 1999/25821, WO 1999/25854, WO 1999/25840, WO 1999/25855 and WO 1999/25853, all of which are herein incorporated by reference.

In some embodiments the polynucleotides encoding the IPD090 polypeptide disclosed herein, alone or stacked with one or more additional insect resistance traits can be stacked with one or more additional input traits (e.g., herbicide resistance, fungal resistance, virus resistance, stress tolerance, disease resistance, male sterility, stalk strength, and the like) or output traits (e.g., increased yield, modified starches, improved oil profile, balanced amino acids, high lysine or methionine, increased digestibility, improved fiber quality, drought resistance, and the like). Thus, the polynucleotide embodiments can be used to provide a complete agronomic package of improved crop quality with the ability to flexibly and cost effectively control any number of agronomic pests.

Transgenes useful for stacking include but are not limited to:

1. Transgenes that Confer Resistance to Insects or Disease and that Encode:

(A) Plant disease resistance genes. Plant defenses are often activated by specific interaction between the product of a disease resistance gene (R) in the plant and the product of a corresponding avirulence (Avr) gene in the pathogen. A plant variety can be transformed with cloned resistance gene to engineer plants that are resistant to specific pathogen strains. See, for example, Jones, et al., (1994) *Science* 266:789 (cloning of the tomato Cf-9 gene for resistance to *Cladosporium fulvum*); Martin, et al., (1993) *Science* 262:1432 (tomato Pto gene for resistance to *Pseudomonas syringae* pv. tomato encodes a protein kinase); Mindrinos, et al., (1994) *Cell* 78:1089 (*Arabidopsis* RSP2 gene for resistance to *Pseudomonas syringae*), McDowell and Woffenden, (2003) *Trends Biotechnol.* 21(4):178-83 and Toyoda, et al., (2002) *Transgenic Res.* 11(6):567-82. A plant resistant to a disease is one that is more resistant to a pathogen as compared to the wild type plant.

(B) Genes encoding a *Bacillus thuringiensis* protein, a derivative thereof or a synthetic polypeptide modeled thereon. See, for example, Geiser, et al., (1986) *Gene* 48:109, who disclose the cloning and nucleotide sequence of a Bt delta-endotoxin gene. Moreover, DNA molecules encoding delta-endotoxin genes can be purchased from American Type Culture Collection (Rockville, Md.), for example, under ATCC® Accession Numbers 40098, 67136, 31995 and 31998. Other non-limiting examples of *Bacillus thuringiensis* transgenes being genetically engineered are given in the following patents and patent applications and hereby are incorporated by reference for this purpose: U.S. Pat. Nos. 5,188,960; 5,689,052; 5,880,275; 5,986,177; 6,023,013, 6,060,594, 6,063,597, 6,077,824, 6,620,988, 6,642,030, 6,713,259, 6,893,826, 7,105,332; 7,179,965, 7,208,474; 7,227,056, 7,288,643, 7,323,556, 7,329,736, 7,449,552, 7,468,278, 7,510,878, 7,521,235, 7,544,862, 7,605,304, 7,696,412, 7,629,504, 7,705,216, 7,772,465, 7,790,846, 7,858,849, 9,546,378; US Patent Publication US20160376607 and WO 1991/14778; WO 1999/31248; WO 2001/12731; WO 1999/24581 and WO 1997/40162.

Genes encoding pesticidal proteins may also be stacked including but are not limited to: insecticidal proteins from *Pseudomonas* sp. such as PSEEN3174 (Monalysin, (2011) *PLoS Pathogens*, 7:1-13), from *Pseudomonas protegens* strain CHAO and Pf-5 (previously *fluorescens*) (Pechy-Tarr, (2008) *Environmental Microbiology* 10:2368-2386: GenBank Accession No. EU400157); from *Pseudomonas taiwanensis* (Liu, et al., (2010) *J. Agric. Food Chem.* 58:12343-12349) and from *Pseudomonas pseudoalcaligenes* (Zhang, et al., (2009) *Annals of Microbiology* 59:45-50 and Li, et al., (2007) *Plant Cell Tiss. Organ Cult.* 89:159-168); insecticidal proteins from *Photorhabdus* sp. and *Xenorhabdus* sp. (Hinchliffe, et al., (2010) *The Open Toxinology Journal* 3:101-118 and Morgan, et al., (2001) *Applied and Envir. Micro.* 67:2062-2069), U.S. Pat. Nos. 6,048,838, and 6,379,946; a PIP-1 polypeptide of US Patent Publication US20140007292; an AflP-1A and/or AflP-1B polypeptide of US Patent Publication US20140033361; a PHI-4 polypeptide of US Patent Publication US20140274885 and US20160040184; a PIP-47 polypeptide of PCT Publication Number WO2015/023846, a PIP-72 polypeptide of US Publication Number US20160366891; a PtIP-50 polypeptide and a PtIP-65 polypeptide of PCT Publication Number WO2015/120270; a PtIP-83 polypeptide of PCT Publication Number WO2015/120276; a PtIP-96 polypeptide of PCT Serial Number PCT/US15/55502; an IPD079 polypeptide of PCT Publication Number WO2017/023486; an IPD082 polypeptide of Serial Number PCT/US16/65531; an IPD093 polypeptide of U.S. Ser. No. 62/434,020; an IPD080 polypeptide of US Serial Number U.S. 62/411,318; and δ-endotoxins including, but not limited to, the Cry1, Cry2, Cry3, Cry4, Cry5, Cry6, Cry7, Cry8, Cry9, Cry10, Cry11, Cry12, Cry13, Cry14, Cry15, Cry16, Cry17, Cry18, Cry19, Cry20, Cry21, Cry22, Cry23, Cry24, Cry25, Cry26, Cry27, Cry28, Cry29, Cry30, Cry31, Cry32, Cry33, Cry34, Cry35, Cry36, Cry37, Cry38, Cry39, Cry40, Cry41, Cry42, Cry43, Cry44, Cry45, Cry46, Cry47, Cry49, Cry50, Cry51, Cry52, Cry53, Cry54, Cry55, Cry56, Cry57, Cry58, Cry59, Cry60, Cry61, Cry62, Cry63, Cry64, Cry65, Cry66, Cry67, Cry68, Cry69, Cry70, Cry71, and Cry72 classes of δ-endotoxin genes and the *B. thuringiensis* cytolytic Cyt1 and Cyt2 genes. Members of these classes of *B. thuringiensis* insecticidal proteins well known to one skilled in the art (see, Crickmore, et al., "*Bacillus thuringiensis toxin nomenclature*" (2011), at lifesci.sussex.ac.uk/home/Neil_Crickmore/Bt/ which can be accessed on the world-wide web using the "www" prefix).

Examples of δ-endotoxins also include but are not limited to Cry1A proteins of U.S. Pat. Nos. 5,880,275, 7,858,849 and 8,878,007; a Cry1Ac mutant of U.S. Pat. No. 9,512,187; a DIG-3 or DIG-11 toxin (N-terminal deletion of α-helix 1 and/or α-helix 2 variants of Cry proteins such as Cry1A) of U.S. Pat. Nos. 8,304,604 and 8,304,605, a DIG-10 of U.S. Pat. No. 8,697,857; Cry1B of U.S. patent application Ser. No. 10/525,318, US Patent Application Publication Number US20160194364, and U.S. Pat. Nos. 9,404,121 and 8,772,577; Cry1B variants of PCT Publication Number WO2016/61197 and Serial Number PCT/US17/27160; Cry1C of U.S. Pat. No. 6,033,874; Cry1F of U.S. Pat. Nos. 5,188,960, 6,218,188; Cry1A/F chimeras of U.S. Pat. Nos. 7,070,982; 6,962,705 and 6,713,063); a Cry2 protein such as Cry2Ab protein of U.S. Pat. No. 7,064,249); a Cry3A protein including but not limited to an engineered hybrid insecticidal protein (eHIP) created by fusing unique combinations of variable regions and conserved blocks of at least two different Cry proteins such as Cry3A with Cry1Aa or Cry1Ab (U.S. Pat. Nos. 8,309,516 and 9,522,937); a Cry4 protein; a Cry5 protein; a Cry6 protein; Cry8 proteins of U.S. Pat. Nos. 7,329,736, 7,449,552, 7,803,943, 7,476,781, 7,105,332, 7,339,092 7,378,499 and 7,462,760; a Cry9 protein such as such as members of the Cry9A, Cry9B, Cry9C, Cry9D, Cry9E, and Cry9F families including the Cry9 proteins of U.S. Pat. Nos. 9,000,261 and 8,802,933, and U.S. Ser. No. 62/287,281; a Cry15 protein of Naimov, et al., (2008) *Applied and Environmental Microbiology* 74:7145-7151; a Cry22, a Cry34Ab1 protein of U.S. Pat. Nos. 6,127,180, 6,624,145 and 6,340,593; a truncated Cry34 protein of U.S. Pat. No. 8,816,157; a CryET33 and CryET34 protein of U.S. Pat. Nos. 6,248,535, 6,326,351, 6,399,330, 6,949,626, 7,385,107 and 7,504,229; a CryET33 and CryET34 homologs of US Patent Publication Number 2006/0191034, 2012/0278954, and PCT Publication Number WO 2012/139004; a Cry35Ab1 protein of U.S. Pat. Nos. 6,083,499, 6,548,291 and 6,340,593; a Cry46 protein of U.S. Pat. No. 9,403,881, a Cry51 protein, a Cry binary toxin; a TIC901 or related toxin; TIC807 of US 2008/0295207; TIC853 of US Patent U.S. Pat. No. 8,513,493; ET29, ET37, TIC809, TIC810, TIC812, TIC127, TIC128 of PCT US 2006/033867; engineered Hemipteran toxic proteins of US Patent Application Publication Number US20160150795; TIC1498, TIC1415, TIC1497, TIC1886, TIC1925, TIC1414, TIC1885, TIC1922, TIC1422, TIC 1974, TIC2032, TIC2120, TIC1362 of US Patent U.S. Pat. No. 9,238,678; a TIC2463-type protein of US Patent Application Publication Number US20150274786; TIC3668-type protein of US Patent Application Publication Number US20160319302; AXMI-027, AXMI-036, and AXMI-038 of U.S. Pat. No. 8,236,757; AXMI-031, AXMI-039, AXMI-040, AXMI-049 of U.S. Pat. No. 7,923,602; AXMI-018, AXMI-020, and AXMI-021 of WO 2006/083891; AXMI-010 of WO 2005/038032; AXMI-003 of WO 2005/021585; AXMI-008 of US 2004/0250311; AXMI-006 of US 2004/0216186; AXMI-007 of US 2004/0210965; AXMI-009 of US 2004/0210964; AXMI-014 of US 2004/0197917; AXMI-004 of US 2004/0197916; AXMI-028 and AXMI-029 of WO 2006/119457; AXMI-007, AXMI-008, AXMI-0080rf2, AXMI-009, AXMI-014 and AXMI-004 of WO 2004/074462; AXMI-150 of U.S. Pat. No. 8,084,416; AXMI-205 of US20110023184; AXMI-011, AXMI-012, AXMI-013, AXMI-015, AXMI-019, AXMI-044, AXMI-037, AXMI-043, AXMI-033, AXMI-034, AXMI-022, AXMI-023, AXMI-041, AXMI-063, and AXMI-064 of US 2011/0263488; AXMI-R1 and related proteins of US 2010/0197592; AXMI221Z, AXMI222z, AXMI223z, AXMI224z and AXMI225z of WO 2011/103248; AXMI218, AXMI219, AXMI220, AXMI226, AXMI227, AXMI228, AXMI229, AXMI230, and AXMI231 of U.S. Pat. No. 9,156,895; AXMI-115, AXMI-113, AXMI-005, AXMI-163 and AXMI-184 of U.S. Pat. No. 8,334,431; AXMI-001, AXMI-002, AXMI-030, AXMI-035, and AXMI-045 of US 2010/0298211; AXMI-066 and AXMI-076 of US2009/0144852; AXMI128, AXMI130, AXMI131, AXMI133, AXMI140, AXMI141, AXMI142, AXMI143, AXMI144, AXMI146, AXMI148, AXMI149, AXMI152, AXMI153, AXMI154, AXMI155, AXMI156, AXMI157, AXMI158, AXMI162, AXMI165, AXMI166, AXMI167, AXMI168, AXMI169, AXMI170, AXMI171, AXMI172, AXMI173, AXMI174, AXMI175, AXMI176, AXMI177, AXMI178, AXMI179, AXMI180, AXMI181, AXMI182, AXMI185, AXMI186, AXMI187, AXMI188, AXMI189 of U.S. Pat. No. 8,318,900; AXMI079, AXMI080, AXMI081, AXMI082, AXMI091, AXMI092, AXMI096, AXMI097, AXMI098, AXMI099, AXMI100, AXMI101, AXMI102, AXMI103, AXMI104, AXMI107, AXMI108, AXMI109, AXMI110, AXMI111, AXMI112, AXMI114, AXMI116, AXMI117, AXMI118, AXMI119, AXMI120, AXMI121, AXMI122, AXMI123, AXMI124, AXMI125, AXMI126, AXMI127, AXMI129, AXMI164, AXMI151, AXMI161, AXMI183, AXMI132, AXMI138, AXMI137 of US U.S. Pat. No. 8,461,421; AXMI192 of US Patent U.S. Pat. No. 8,461,415; AXMI234 and AXMI235 of US Patent Application Publication Number US20150218583; AXMI281 of US Patent Application Publication Number US20160177332; AXMI422 of U.S. Pat. No. 8,252,872; and Cry proteins such as Cry1A and Cry3A having modified proteolytic sites of U.S. Pat. No. 8,319,019; a modified Cry3 of U.S. Pat. No. 9,109,231; and a Cry1Ac, Cry2Aa and Cry1 Ca toxin protein from *Bacillus thuringiensis* strain VBTS 2528 of US Patent Application Publication Number 2011/0064710. The Cry proteins MP032, MP049, MP051, MP066, MP068, MP070, MP091S, MP109S, MP114, MP121, MP134S, MP183S, MP185S, MP186S, MP195S, MP197S, MP208S, MP209S, MP212S, MP214S, MP217S, MP222S, MP234S, MP235S, MP237S, MP242S, MP243, MP248, MP249S, MP251M, MP252S, MP253, MP259S, MP287S, MP288S, MP295S, MP296S, MP297S, MP300S, MP304S, MP306S, MP310S, MP312S, MP314S, MP319S, MP325S, MP326S, MP327S, MP328S, MP334S, MP337S, MP342S, MP349S, MP356S, MP359S, MP360S, MP437S, MP451S, MP452S, MP466S, MP468S, MP476S, MP482S, MP522S, MP529S, MP548S, MP552S, MP562S, MP564S, MP566S, MP567S, MP569S, MP573S, MP574S, MP575S, MP581S, MP590, MP594S, MP596S, MP597, MP599S, MP600S, MP601S, MP602S, MP604S, MP626S, MP629S, MP630S, MP631S, MP632S, MP633S, MP634S, MP635S, MP639S, MP640S, MP644S, MP649S, MP651S, MP652S, MP653S, MP661S, MP666S, MP672S, MP696S, MP704S, MP724S, MP729S, MP739S, MP755S, MP773S, MP799S, MP800S, MP801S, MP802S, MP803S, MP805S, MP809S, MP815S, MP828S, MP831S, MP844S, MP852, MP865S, MP879S, MP887S, MP891S, MP896S, MP898S, MP935S, MP968, MP989, MP993, MP997, MP1049, MP1066, MP1067, MP1080, MP1081, MP1200, MP1206, MP1233, and MP1311 of U.S. Ser. No. 62/429,426. Other Cry proteins are well known to one skilled in the art (see, Crickmore, et al., "*Bacillus thuringiensis* toxin nomenclature" (2011), at lifesci.sussex.ac.uk/home/Neil_Crickmore/Bt/ which can be accessed on the world-wide web using the "www" prefix). The insecticidal activity of Cry proteins is well known to one skilled in the art (for review, see, van Frannkenhuyzen, (2009) *J. Invert. Path.* 101:1-16). The use of Cry proteins as transgenic plant traits is well known to one skilled in the art and Cry-transgenic plants including but not limited to Cry1Ac, Cry1Ac+Cry2Ab, Cry1Ab, Cry1A.105, Cry1F, Cry1Fa2, Cry1F+Cry1Ac, Cry2Ab, Cry3A, mCry3A (US Patent U.S. Pat. No. 7,276,583), Cry3Bb1, Cry34Ab1, Cry35Ab1, Vip3A, mCry3A (US Patent U.S. Pat. No. 7,276,583), Cry9c and CBI-Bt have received regulatory approval (see, Sanahuja, (2011) *Plant Biotech Journal* 9:283-300 and the CERA (2010) GM Crop Database Center for Environmental Risk Assessment (CERA), ILSI Research Foundation, Washington D.C. at cera-gmc.org/index.php?action=gm_crop_database which can be accessed on the world-wide web using the "www" prefix). More than one pesticidal proteins well known to one skilled in the art can also be expressed in plants such as Vip3Ab & Cry1Fa (US2012/0317682), Cry1BE & Cry1F (US2012/0311746), Cry1CA & Cry1AB (US2012/0311745), Cry1F & CryCa (US2012/0317681), Cry1DA & Cry1BE (US2012/0331590), Cry1DA & Cry1Fa (US2012/0331589), Cry1AB & Cry1BE (US2012/0324606), and Cry1Fa & Cry2Aa, Cry1I or Cry1E (US2012/0324605). Pesticidal proteins also include insecticidal lipases including lipid acyl hydrolases of U.S. Pat. No. 7,491,869, and cholesterol oxidases such as from *Streptomyces* (Purcell et al. (1993) *Biochem Biophys Res Commun* 15:1406-1413). Pesticidal proteins also include VIP (vegetative insecticidal proteins) toxins of U.S. Pat. Nos. 5,877,012, 6,107,279, 6,137,033, 7,244,820, 7,615,686, and 8,237,020, and the like. Other VIP proteins are well known to one skilled in the art (see, lifesci.sussex.ac.uk/home/Neil_Crickmore/Bt/vip.html which can be accessed on the world-wide web using the "www" prefix). Pesticidal proteins also include toxin complex (TC) proteins, obtainable from organisms such as *Xenorhabdus, Photorhabdus* and *Paenibacillus* (see, U.S. Pat. Nos. 7,491,698 and 8,084,418). Some TC proteins have "stand alone" insecticidal activity and other TC proteins enhance the activity of the stand-alone toxins produced by the same given organism. The toxicity of a "stand-alone" TC protein (from *Photorhabdus, Xenorhabdus* or *Paenibacillus*, for example) can be enhanced by one or more TC protein "potentiators" derived from a source organism of a different genus. There are three main types of TC proteins. As referred to herein, Class A proteins ("Protein A") are stand-alone toxins. Class B proteins ("Protein B") and Class C proteins ("Protein C") enhance the toxicity of Class A proteins. Examples of Class A proteins are TcbA, TcdA, XptA1 and XptA2. Examples of Class B proteins are TcaC, TcdB, XptB1Xb and XptC1Wi. Examples of Class C proteins are TccC, XptC1Xb and XptB1Wi. Pesticidal proteins also include spider, snake and scorpion venom proteins. Examples of spider venom peptides include but are not limited to lycotoxin-1 peptides and mutants thereof (U.S. Pat. No. 8,334,366).

(C) A polynucleotide encoding an insect-specific hormone or pheromone such as an ecdysteroid and juvenile hormone, a variant thereof, a mimetic based thereon or an antagonist or agonist thereof. See, for example, the disclosure by Hammock, et al., (1990) *Nature* 344:458, of baculovirus expression of cloned juvenile hormone esterase, an inactivator of juvenile hormone.

(D) A polynucleotide encoding an insect-specific peptide which, upon expression, disrupts the physiology of the affected pest. For example, see the disclosures of, Regan, (1994) *J. Biol. Chem.* 269:9 (expression cloning yields DNA coding for insect diuretic hormone receptor); Pratt, et al., (1989) *Biochem. Biophys. Res. Comm.* 163:1243 (an allostatin is identified in *Diploptera puntata*); Chattopadhyay, et al., (2004) *Critical Reviews in Microbiology* 30(1):33-54; Zjawiony, (2004) *J Nat Prod* 67(2):300-310; Carlini and Grossi-de-Sa, (2002) *Toxicon* 40(11):1515-1539; Ussuf, et al., (2001) *Curr Sci.* 80(7):847-853 and Vasconcelos and Oliveira, (2004) *Toxicon* 44(4):385-403. See also, U.S. Pat. No. 5,266,317 to Tomalski, et al., who disclose genes encoding insect-specific toxins.

(E) A polynucleotide encoding an enzyme responsible for a hyperaccumulation of a monoterpene, a sesquiterpene, a steroid, hydroxamic acid, a phenylpropanoid derivative or another non-protein molecule with insecticidal activity.

(F) A polynucleotide encoding an enzyme involved in the modification, including the post-translational modification, of a biologically active molecule; for example, a glycolytic enzyme, a proteolytic enzyme, a lipolytic enzyme, a nuclease, a cyclase, a transaminase, an esterase, a hydrolase, a phosphatase, a kinase, a phosphorylase, a polymerase, an elastase, a chitinase and a glucanase, whether natural or synthetic. See, PCT Application WO 1993/02197 in the name of Scott, et al., which discloses the nucleotide sequence of a callase gene. DNA molecules which contain chitinase-encoding sequences can be obtained, for example, from the ATCC® under Accession Numbers 39637 and 67152. See also, Kramer, et al., (1993) *Insect Biochem. Molec. Biol.* 23:691, who teach the nucleotide sequence of a cDNA encoding tobacco hookworm chitinase and Kawalleck, et al., (1993) *Plant Molec. Biol.* 21:673, who provide the nucleotide sequence of the parsley ubi4-2 polyubiquitin gene, and U.S. Pat. Nos. 6,563,020; 7,145,060 and 7,087,810.

(G) A polynucleotide encoding a molecule that stimulates signal transduction. For example, see the disclosure by Botella, et al., (1994) *Plant Molec. Biol.* 24:757, of nucleotide sequences for mung bean calmodulin cDNA clones, and Griess, et al., (1994) *Plant Physiol.* 104:1467, who provide the nucleotide sequence of a maize calmodulin cDNA clone.

(H) A polynucleotide encoding a hydrophobic moment peptide. See, PCT Application WO 1995/16776 and U.S. Pat. No. 5,580,852 disclosure of peptide derivatives of Tachyplesin which inhibit fungal plant pathogens) and PCT Application WO 1995/18855 and U.S. Pat. No. 5,607,914 (teaches synthetic antimicrobial peptides that confer disease resistance).

(I) A polynucleotide encoding a membrane permease, a channel former or a channel blocker. For example, see the disclosure by Jaynes, et al., (1993) *Plant Sci.* 89:43, of heterologous expression of a cecropin-beta lytic peptide analog to render transgenic tobacco plants resistant to *Pseudomonas solanacearum*.

(J) A gene encoding a viral-invasive protein or a complex toxin derived therefrom. For example, the accumulation of viral coat proteins in transformed plant cells imparts resistance to viral infection and/or disease development effected by the virus from which the coat protein gene is derived, as well as by related viruses. See, Beachy, et al., (1990) *Ann. Rev. Phytopathol.* 28:451. Coat protein-mediated resistance has been conferred upon transformed plants against alfalfa mosaic virus, cucumber mosaic virus, tobacco streak virus, potato virus X, potato virus Y, tobacco etch virus, tobacco rattle virus and tobacco mosaic virus. Id.

(K) A gene encoding an insect-specific antibody or an immunotoxin derived therefrom. Thus, an antibody targeted to a critical metabolic function in the insect gut would inactivate an affected enzyme, killing the insect. Cf. Taylor, et al., Abstract #497, SEVENTH INT'L SYMPOSIUM ON MOLECULAR PLANT-MICROBE INTERACTIONS (Edinburgh, Scotland, 1994) (enzymatic inactivation in transgenic tobacco via production of single-chain antibody fragments).

(L) A gene encoding a virus-specific antibody. See, for example, Tavladoraki, et al., (1993) *Nature* 366:469, who show that transgenic plants expressing recombinant antibody genes are protected from virus attack.

(M) A polynucleotide encoding a developmental-arrestive protein produced in nature by a pathogen or a parasite. Thus, fungal endo alpha-1,4-D-polygalacturonases facilitate fungal colonization and plant nutrient release by solubilizing plant cell wall homo-alpha-1,4-D-galacturonase. See, Lamb, et al., (1992) *Bio/Technology* 10:1436. The cloning and characterization of a gene which encodes a bean endopolygalacturonase-inhibiting protein is described by Toubart, et al., (1992) *Plant J.* 2:367.

(N) A polynucleotide encoding a developmental-arrestive protein produced in nature by a plant. For example, Logemann, et al., (1992) *Bio/Technology* 10:305, have shown that transgenic plants expressing the barley ribosome-inactivating gene have an increased resistance to fungal disease.

(O) Genes involved in the Systemic Acquired Resistance (SAR) Response and/or the pathogenesis related genes. Briggs, (1995) *Current Biology* 5(2), Pieterse and Van Loon, (2004) *Curr. Opin. Plant Bio.* 7(4):456-64 and Somssich, (2003) *Cell* 113(7):815-6.

(P) Antifungal genes (Cornelissen and Melchers, (1993) *Pl. Physiol.* 101:709-712 and Parijs, et al., (1991) *Planta* 183:258-264 and Bushnell, et al., (1998) *Can. J. of Plant Path.* 20(2):137-149. Also see, U.S. patent application Ser. Nos. 09/950,933; 11/619,645; 11/657,710; 11/748,994; 11/774,121 and U.S. Pat. Nos. 6,891,085 and 7,306,946. LysM Receptor-like kinases for the perception of chitin fragments as a first step in plant defense response against fungal pathogens (US 2012/0110696).

(Q) Detoxification genes, such as for fumonisin, beauvericin, moniliformin and zearalenone and their structurally related derivatives. For example, see, U.S. Pat. Nos. 5,716, 820; 5,792,931; 5,798,255; 5,846,812; 6,083,736; 6,538, 177; 6,388,171 and 6,812,380.

(R) A polynucleotide encoding a Cystatin and cysteine proteinase inhibitors. See, U.S. Pat. No. 7,205,453.

(S) Defensin genes. See, WO 2003/000863 and U.S. Pat. Nos. 6,911,577; 6,855,865; 6,777,592 and 7,238,781.

(T) Genes conferring resistance to nematodes. See, e.g., PCT Application WO 1996/30517; PCT Application WO 1993/19181, WO 2003/033651 and Urwin, et al., (1998) *Planta* 204:472-479, Williamson, (1999) *Curr Opin Plant Bio.* 2(4):327-31; U.S. Pat. Nos. 6,284,948 and 7,301,069 and miR164 genes (WO 2012/058266).

(U) Genes that confer resistance to *Phytophthora* Root Rot, such as the Rps 1, Rps 1-a, Rps 1-b, Rps 1-c, Rps 1-d, Rps 1-e, Rps 1-k, Rps 2, Rps 3-a, Rps 3-b, Rps 3-c, Rps 4, Rps 5, Rps 6, Rps 7 and other Rps genes. See, for example, Shoemaker, et al., *Phytophthora* Root Rot Resistance Gene Mapping in Soybean, Plant Genome IV Conference, San Diego, Calif. (1995).

(V) Genes that confer resistance to Brown Stem Rot, such as described in U.S. Pat. No. 5,689,035 and incorporated by reference for this purpose.

(W) Genes that confer resistance to *Colletotrichum*, such as described in US Patent Application Publication US 2009/0035765 and incorporated by reference for this purpose. This includes the Rcg locus that may be utilized as a single locus conversion.

2. Transgenes that Confer Resistance to a Herbicide, for Example:

(A) A polynucleotide encoding resistance to a herbicide that inhibits the growing point or meristem, such as an imidazolinone or a sulfonylurea. Exemplary genes in this category code for mutant ALS and AHAS enzyme as described, for example, by Lee, et al., (1988) *EMBO J.* 7:1241 and Miki, et al., (1990) *Theor. Appl. Genet.* 80:449, respectively. See also, U.S. Pat. Nos. 5,605,011; 5,013,659; 5,141,870; 5,767,361; 5,731,180; 5,304,732; 4,761,373; 5,331,107; 5,928,937 and 5,378,824; U.S. patent application Ser. No. 11/683,737 and International Publication WO 1996/33270.

(B) A polynucleotide encoding a protein for resistance to Glyphosate (resistance imparted by mutant 5-enolpyruvl-3-phosphikimate synthase (EPSP) and aroA genes, respectively) and other phosphono compounds such as glufosinate (phosphinothricin acetyl transferase (PAT) and *Streptomyces hygroscopicus* phosphinothricin acetyl transferase (bar) genes), and pyridinoxy or phenoxy proprionic acids and cyclohexones (ACCase inhibitor-encoding genes). See, for example, U.S. Pat. No. 4,940,835 to Shah, et al., which discloses the nucleotide sequence of a form of EPSPS which can confer glyphosate resistance. U.S. Pat. No. 5,627,061 to Barry, et al., also describes genes encoding EPSPS enzymes. See also, U.S. Pat. Nos. 6,566,587; 6,338,961; 6,248,876; 6,040,497; 5,804,425; 5,633,435; 5,145,783; 4,971,908; 5,312,910; 5,188,642; 5,094,945, 4,940,835; 5,866,775; 6,225,114; 6,130,366; 5,310,667; 4,535,060; 4,769,061; 5,633,448; 5,510,471; Re. 36,449; RE 37,287 E and 5,491, 288 and International Publications EP 1173580; WO 2001/66704; EP 1173581 and EP 1173582, which are incorporated herein by reference for this purpose. Glyphosate resistance is also imparted to plants that express a gene encoding a glyphosate oxido-reductase enzyme as described more fully in U.S. Pat. Nos. 5,776,760 and 5,463,175, which are incorporated herein by reference for this purpose. In addition, glyphosate resistance can be imparted to plants by the over expression of genes encoding glyphosate N-acetyltransferase. See, for example, U.S. Pat. Nos. 7,462,481; 7,405,074 and US Patent Application Publication Number US 2008/0234130. A DNA molecule encoding a mutant aroA gene can be obtained under ATCC® Accession Number 39256, and the nucleotide sequence of the mutant gene is disclosed in U.S. Pat. No. 4,769,061 to Comai. EP Application Number 0 333 033 to Kumada, et al., and U.S. Pat. No. 4,975,374 to Goodman, et al., disclose nucleotide sequences of glutamine synthetase genes which confer resistance to herbicides such as L-phosphinothricin. The nucleotide sequence of a phosphinothricin-acetyl-transferase gene is provided in EP Application Numbers 0 242 246 and 0 242 236 to Leemans, et al., De Greef, et al., (1989) *Bio/Technology* 7:61, describe the production of transgenic plants that express chimeric bar genes coding for phosphinothricin acetyl transferase activity. See also, U.S. Pat. Nos. 5,969,213; 5,489,520; 5,550,318; 5,874,265; 5,919,675; 5,561,236; 5,648,477; 5,646,024; 6,177,616 and 5,879,903, which are incorporated herein by reference for this purpose. Exemplary genes conferring resistance to phenoxy proprionic acids and cyclohexones, such as sethoxydim and haloxyfop, are the Acc1-S1, Acc1-S2 and Acc1-S3 genes described by Marshall, et al., (1992) *Theor. Appl. Genet.* 83:435.

(C) A polynucleotide encoding a protein for resistance to herbicide that inhibits photosynthesis, such as a triazine (psbA and gs+ genes) and a benzonitrile (nitrilase gene). Przibilla, et al., (1991) Plant Cell 3:169, describe the transformation of *Chlamydomonas* with plasmids encoding mutant psbA genes. Nucleotide sequences for nitrilase genes are disclosed in U.S. Pat. No. 4,810,648 to Stalker and DNA molecules containing these genes are available under ATCC® Accession Numbers 53435, 67441 and 67442. Cloning and expression of DNA coding for a glutathione S-transferase is described by Hayes, et al., (1992) *Biochem. J.* 285:173.

(D) A polynucleotide encoding a protein for resistance to Acetohydroxy acid synthase, which has been found to make plants that express this enzyme resistant to multiple types of herbicides, has been introduced into a variety of plants (see, e.g., Hattori, et al., (1995) *Mol Gen Genet.* 246:419). Other genes that confer resistance to herbicides include: a gene encoding a chimeric protein of rat cytochrome P4507A1 and yeast NADPH-cytochrome P450 oxidoreductase (Shiota, et al., (1994) *Plant Physiol* 106:17), genes for glutathione reductase and superoxide dismutase (Aono, et al., (1995) *Plant Cell Physiol* 36:1687) and genes for various phosphotransferases (Datta, et al., (1992) *Plant Mol Biol* 20:619).

(E) A polynucleotide encoding resistance to a herbicide targeting Protoporphyrinogen oxidase (protox) which is necessary for the production of chlorophyll. The protox enzyme serves as the target for a variety of herbicidal compounds. These herbicides also inhibit growth of all the different species of plants present, causing their total destruction. The development of plants containing altered protox activity which are resistant to these herbicides are described in U.S. Pat. Nos. 6,288,306; 6,282,83 and 5,767,373 and International Publication WO 2001/12825.

(F) The aad-1 gene (originally from *Sphingobium herbicidovorans*) encodes the aryloxyalkanoate dioxygenase (AAD-1) protein. The trait confers tolerance to 2,4-dichlorophenoxyacetic acid and aryloxyphenoxypropionate (commonly referred to as "fop" herbicides such as quizalofop) herbicides. The aad-1 gene, itself, for herbicide tolerance in plants was first disclosed in WO 2005/107437 (see also, US 2009/0093366). The aad-12 gene, derived from *Delftia acidovorans*, which encodes the aryloxyalkanoate dioxygenase (AAD-12) protein that confers tolerance to 2,4-dichlorophenoxyacetic acid and pyridyloxyacetate herbicides by deactivating several herbicides with an aryloxyalkanoate moiety, including phenoxy auxin (e.g., 2,4-D, MCPA), as well as pyridyloxy auxins (e.g., fluroxypyr, triclopyr).

(G) A polynucleotide encoding a herbicide resistant dicamba monooxygenase disclosed in US Patent Application Publication 2003/0135879 for imparting dicamba tolerance;

(H) A polynucleotide molecule encoding bromoxynil nitrilase (Bxn) disclosed in U.S. Pat. No. 4,810,648 for imparting bromoxynil tolerance;

(I) A polynucleotide molecule encoding phytoene (crtI) described in Misawa, et al., (1993) *Plant J.* 4:833-840 and in Misawa, et al., (1994) *Plant J.* 6:481-489 for norflurazon tolerance.

3. Transgenes that Confer or Contribute to an Altered Grain Characteristic

Such as:

(A) Altered fatty acids, for example, by (1) Down-regulation of stearoyl-ACP to increase stearic acid content of the plant. See, Knultzon, et al., (1992) *Proc. Natl. Acad. Sci. USA* 89:2624 and WO 1999/64579 (Genes to Alter Lipid Profiles in Corn).

(2) Elevating oleic acid via FAD-2 gene modification and/or decreasing linolenic acid via FAD-3 gene modification (see, U.S. Pat. Nos. 6,063,947; 6,323,392; 6,372,965 and WO 1993/11245).

(3) Altering conjugated linolenic or linoleic acid content, such as in WO 2001/12800.

(4) Altering LEC1, AGP, Dek1, Superal1, mi1 ps, and various lpa genes such as Ipa1, Ipa3, hpt or hggt. For example, see, WO 2002/42424, WO 1998/22604, WO 2003/011015, WO 2002/057439, WO 2003/011015, U.S. Pat. Nos. 6,423,886, 6,197,561, 6,825,397 and US Patent Application Publication Numbers US 2003/0079247, US 2003/0204870 and Rivera-Madrid, et al., (1995) *Proc. Natl. Acad. Sci.* 92:5620-5624.

(5) Genes encoding delta-8 desaturase for making long-chain polyunsaturated fatty acids (U.S. Pat. Nos. 8,058,571 and 8,338,152), delta-9 desaturase for lowering saturated fats (U.S. Pat. No. 8,063,269), Primula Δ6-desaturase for improving omega-3 fatty acid profiles.

(6) Isolated nucleic acids and proteins associated with lipid and sugar metabolism regulation, in particular, lipid metabolism protein (LMP) used in methods of producing transgenic plants and modulating levels of seed storage compounds including lipids, fatty acids, starches or seed storage proteins and use in methods of modulating the seed size, seed number, seed weights, root length and leaf size of plants (EP 2404499).

(7) Altering expression of a High-Level Expression of Sugar-Inducible 2 (HSI2) protein in the plant to increase or decrease expression of HSI2 in the plant. Increasing expression of HSI2 increases oil content while decreasing expression of HSI2 decreases abscisic acid sensitivity and/or increases drought resistance (US Patent Application Publication Number 2012/0066794).

(8) Expression of cytochrome b5 (Cb5) alone or with FAD2 to modulate oil content in plant seed, particularly to increase the levels of omega-3 fatty acids and improve the ratio of omega-6 to omega-3 fatty acids (US Patent Application Publication Number 2011/0191904).

(9) Nucleic acid molecules encoding wrinkled1-like polypeptides for modulating sugar metabolism (U.S. Pat. No. 8,217,223).

(B) Altered phosphorus content, for example, by the (1) Introduction of a phytase-encoding gene would enhance breakdown of phytate, adding more free phosphate to the transformed plant. For example, see, Van Hartingsveldt, et al., (1993) *Gene* 127:87, for a disclosure of the nucleotide sequence of an *Aspergillus niger* phytase gene.

(2) Modulating a gene that reduces phytate content. In maize, this, for example, could be accomplished, by cloning and then re-introducing DNA associated with one or more of the alleles, such as the LPA alleles, identified in maize mutants characterized by low levels of phytic acid, such as in WO 2005/113778 and/or by altering inositol kinase activity as in WO 2002/059324, US Patent Application Publication Number 2003/0009011, WO 2003/027243, US Patent Application Publication Number 2003/0079247, WO 1999/05298, U.S. Pat. Nos. 6,197,561, 6,291,224, 6,391,348, WO 2002/059324, US Patent Application Publication Number 2003/0079247, WO 1998/45448, WO 1999/55882, WO 2001/04147.

(C) Altered carbohydrates affected, for example, by altering a gene for an enzyme that affects the branching pattern of starch or, a gene altering thioredoxin such as NTR and/or TRX (see, U.S. Pat. No. 6,531,648, which is incorporated by reference for this purpose) and/or a gamma zein knock out or mutant such as cs27 or TUSC27 or en27 (see, U.S. Pat. No. 6,858,778 and US Patent Application Publication Number 2005/0160488, US Patent Application Publication Number 2005/0204418, which are incorporated by reference for this purpose). See, Shiroza, et al., (1988) *J. Bacteriol.* 170:810 (nucleotide sequence of *Streptococcus* mutant fructosyltransferase gene), Steinmetz, et al., (1985) *Mol. Gen. Genet.* 200:220 (nucleotide sequence of *Bacillus subtilis* levansucrase gene), Pen, et al., (1992) *Bio/Technology* 10:292 (production of transgenic plants that express *Bacillus licheniformis* alpha-amylase), Elliot, et al., (1993) *Plant Molec. Biol.* 21:515 (nucleotide sequences of tomato invertase genes), Søgaard, et al., (1993) *J. Biol. Chem.* 268:22480 (site-directed mutagenesis of barley alpha-amylase gene) and Fisher, et al., (1993) *Plant Physiol.* 102:1045 (maize endosperm starch branching enzyme II), WO 1999/10498 (improved digestibility and/or starch extraction through modification of UDP-D-xylose 4-epimerase, Fragile 1 and 2, Ref1, HCHL, C4H), U.S. Pat. No. 6,232,529 (method of producing high oil seed by modification of starch levels (AGP)). The fatty acid modification genes mentioned herein may also be used to affect starch content and/or composition through the interrelationship of the starch and oil pathways.

(D) Altered antioxidant content or composition, such as alteration of tocopherol or tocotrienols. For example, see, U.S. Pat. No. 6,787,683, US Patent Application Publication Number 2004/0034886 and WO 2000/68393 involving the manipulation of antioxidant levels and WO 2003/082899 through alteration of a homogentisate geranyl geranyl transferase (hggt).

(E) Altered essential seed amino acids. For example, see, U.S. Pat. No. 6,127,600 (method of increasing accumulation of essential amino acids in seeds), U.S. Pat. No. 6,080,913 (binary methods of increasing accumulation of essential amino acids in seeds), U.S. Pat. No. 5,990,389 (high lysine), WO 1999/40209 (alteration of amino acid compositions in seeds), WO 1999/29882 (methods for altering amino acid content of proteins), U.S. Pat. No. 5,850,016 (alteration of amino acid compositions in seeds), WO 1998/20133 (proteins with enhanced levels of essential amino acids), U.S. Pat. No. 5,885,802 (high methionine), U.S. Pat. No. 5,885,801 (high threonine), U.S. Pat. No. 6,664,445 (plant amino acid biosynthetic enzymes), U.S. Pat. No. 6,459,019 (increased lysine and threonine), U.S. Pat. No. 6,441,274 (plant tryptophan synthase beta subunit), U.S. Pat. No. 6,346,403 (methionine metabolic enzymes), U.S. Pat. No. 5,939,599 (high sulfur), U.S. Pat. No. 5,912,414 (increased methionine), WO 1998/56935 (plant amino acid biosynthetic enzymes), WO 1998/45458 (engineered seed protein having higher percentage of essential amino acids), WO 1998/42831 (increased lysine), U.S. Pat. No. 5,633,436 (increasing sulfur amino acid content), U.S. Pat. No. 5,559,223 (synthetic storage proteins with defined structure containing programmable levels of essential amino acids for improvement of the nutritional value of plants), WO 1996/01905 (increased threonine), WO 1995/15392 (increased lysine), US Patent Application Publication Number 2003/0163838, US Patent Application Publication Number 2003/0150014, US Patent Application Publication Number 2004/0068767, U.S. Pat. No. 6,803,498, WO 2001/79516.

4. Genes that Control Male-Sterility:

There are several methods of conferring genetic male sterility available, such as multiple mutant genes at separate locations within the genome that confer male sterility, as disclosed in U.S. Pat. Nos. 4,654,465 and 4,727,219 to Brar, et al., and chromosomal translocations as described by Patterson in U.S. Pat. Nos. 3,861,709 and 3,710,511. In addition to these methods, Albertsen, et al., U.S. Pat. No. 5,432,068, describe a system of nuclear male sterility which includes: identifying a gene which is critical to male fertility; silencing this native gene which is critical to male fertility; removing the native promoter from the essential male fertility gene and replacing it with an inducible promoter; inserting this genetically engineered gene back into the plant; and thus creating a plant that is male sterile because the inducible promoter is not "on" resulting in the male fertility gene not being transcribed. Fertility is restored by inducing or turning "on", the promoter, which in turn allows the gene that confers male fertility to be transcribed.

(A) Introduction of a deacetylase gene under the control of a tapetum-specific promoter and with the application of the chemical N—Ac-PPT (WO 2001/29237).

(B) Introduction of various stamen-specific promoters (WO 1992/13956, WO 1992/13957).

(C) Introduction of the barnase and the barstar gene (Paul, et al., (1992) *Plant Mol. Biol.* 19:611-622).

For additional examples of nuclear male and female sterility systems and genes, see also, U.S. Pat. Nos. 5,859,341; 6,297,426; 5,478,369; 5,824,524; 5,850,014 and 6,265,640, all of which are hereby incorporated by reference.

5. Genes that Create a Site for Site Specific DNA Integration.

This includes the introduction of FRT sites that may be used in the FLP/FRT system and/or Lox sites that may be used in the Cre/Loxp system. For example, see, Lyznik, et al., (2003) *Plant Cell Rep* 21:925-932 and WO 1999/25821, which are hereby incorporated by reference. Other systems that may be used include the Gin recombinase of phage Mu (Maeser, et al., (1991) Vicki Chandler, The Maize Handbook ch. 118 (Springer-Verlag 1994), the Pin recombinase of *E. coli* (Enomoto, et al., 1983) and the R/RS system of the pSRi plasmid (Araki, et al., 1992).

6. Genes that Affect Abiotic Stress Resistance

Including but not limited to flowering, ear and seed development, enhancement of nitrogen utilization efficiency, altered nitrogen responsiveness, drought resistance or tolerance, cold resistance or tolerance and salt resistance or tolerance and increased yield under stress.

(A) For example, see: WO 2000/73475 where water use efficiency is altered through alteration of malate; U.S. Pat. Nos. 5,892,009, 5,965,705, 5,929,305, 5,891,859, 6,417,428, 6,664,446, 6,706,866, 6,717,034, 6,801,104, WO 2000/060089, WO 2001/026459, WO 2001/035725, WO 2001/034726, WO 2001/035727, WO 2001/036444, WO 2001/036597, WO 2001/036598, WO 2002/015675, WO 2002/017430, WO 2002/077185, WO 2002/079403, WO 2003/013227, WO 2003/013228, WO 2003/014327, WO 2004/031349, WO 2004/076638, WO 199809521.

(B) WO 199938977 describing genes, including CBF genes and transcription factors effective in mitigating the negative effects of freezing, high salinity and drought on plants, as well as conferring other positive effects on plant phenotype.

(C) US Patent Application Publication Number 2004/0148654 and WO 2001/36596 where abscisic acid is altered in plants resulting in improved plant phenotype such as increased yield and/or increased tolerance to abiotic stress.

(D) WO 2000/006341, WO 2004/090143, U.S. Pat. Nos. 7,531,723 and 6,992,237 where cytokinin expression is modified resulting in plants with increased stress tolerance, such as drought tolerance, and/or increased yield. Also see, WO 2002/02776, WO 2003/052063, JP 2002/281975, U.S. Pat. No. 6,084,153, WO 2001/64898, U.S. Pat. Nos. 6,177,275 and 6,107,547 (enhancement of nitrogen utilization and altered nitrogen responsiveness).

(E) For ethylene alteration, see, US Patent Application Publication Number 2004/0128719, US Patent Application Publication Number 2003/0166197 and WO 2000/32761.

(F) For plant transcription factors or transcriptional regulators of abiotic stress, see, e.g., US Patent Application Publication Number 2004/0098764 or US Patent Application Publication Number 2004/0078852.

(G) Genes that increase expression of vacuolar pyrophosphatase such as AVP1 (U.S. Pat. No. 8,058,515) for increased yield; nucleic acid encoding a HSFA4 or a HSFA5 (Heat Shock Factor of the class A4 or A5) polypeptides, an oligopeptide transporter protein (OPT4-like) polypeptide; a plastochron2-like (PLA2-like) polypeptide or a Wuschel related homeobox 1-like (WOX1-like) polypeptide (U. Patent Application Publication Number US 2011/0283420).

(H) Down regulation of polynucleotides encoding poly (ADP-ribose) polymerase (PARP) proteins to modulate programmed cell death (U.S. Pat. No. 8,058,510) for increased vigor.

(I) Polynucleotide encoding DTP21 polypeptides for conferring drought resistance (US Patent Application Publication Number US 2011/0277181).

(J) Nucleotide sequences encoding ACC Synthase 3 (ACS3) proteins for modulating development, modulating response to stress, and modulating stress tolerance (US Patent Application Publication Number US 2010/0287669).

(K) Polynucleotides that encode proteins that confer a drought tolerance phenotype (DTP) for conferring drought resistance (WO 2012/058528).

(L) Tocopherol cyclase (TC) genes for conferring drought and salt tolerance (US Patent Application Publication Number 2012/0272352).

(M) CAAX amino terminal family proteins for stress tolerance (U.S. Pat. No. 8,338,661).

(N) Mutations in the SAL1 encoding gene have increased stress tolerance, including increased drought resistant (US Patent Application Publication Number 2010/0257633).

(O) Expression of a nucleic acid sequence encoding a polypeptide selected from the group consisting of: GRF polypeptide, RAA1-like polypeptide, SYR polypeptide, ARKL polypeptide, and YTP polypeptide increasing yield-related traits (US Patent Application Publication Number 2011/0061133).

(P) Modulating expression in a plant of a nucleic acid encoding a Class III Trehalose Phosphate Phosphatase (TPP) polypeptide for enhancing yield-related traits in plants, particularly increasing seed yield (US Patent Application Publication Number 2010/0024067).

Other genes and transcription factors that affect plant growth and agronomic traits such as yield, flowering, plant growth and/or plant structure, can be introduced or introgressed into plants, see e.g., WO 1997/49811 (LHY), WO 1998/56918 (ESD4), WO 1997/10339 and U.S. Pat. No. 6,573,430 (TFL), U.S. Pat. No. 6,713,663 (FT), WO 1996/14414 (CON), WO 1996/38560, WO 2001/21822 (VRN1), WO 2000/44918 (VRN2), WO 1999/49064 (GI), WO 2000/46358 (FR1), WO 1997/29123, U.S. Pat. Nos. 6,794,560, 6,307,126 (GAI), WO 1999/09174 (D8 and Rht) and WO 2004/076638 and WO 2004/031349 (transcription factors).

7. Genes that Confer Increased Yield (A) A transgenic crop plant transformed by a 1-Amino-Cyclopropane-1-Carboxylate Deaminase-like Polypeptide (ACCDP) coding nucleic acid, wherein expression of the nucleic acid sequence in the crop plant results in the plant's increased root growth, and/or increased yield, and/or increased tolerance to environmental stress as compared to a wild type variety of the plant (U.S. Pat. No. 8,097,769).

(B) Over-expression of maize zinc finger protein gene (Zm-ZFP1) using a seed preferred promoter has been shown to enhance plant growth, increase kernel number and total kernel weight per plant (US Patent Application Publication Number 2012/0079623).

(C) Constitutive over-expression of maize lateral organ boundaries (LOB) domain protein (Zm-LOBDP1) has been shown to increase kernel number and total kernel weight per plant (US Patent Application Publication Number 2012/0079622).

(D) Enhancing yield-related traits in plants by modulating expression in a plant of a nucleic acid encoding a VIM1 (Variant in Methylation 1)-like polypeptide or a VTC2-like (GDP-L-galactose phosphorylase) polypeptide or a DUF1685 polypeptide or an ARF6-like (Auxin Responsive Factor) polypeptide (WO 2012/038893).

(E) Modulating expression in a plant of a nucleic acid encoding a Ste20-like polypeptide or a homologue thereof gives plants having increased yield relative to control plants (EP 2431472).

(F) Genes encoding nucleoside diphosphatase kinase (NDK) polypeptides and homologs thereof for modifying the plant's root architecture (US Patent Application Publication Number 2009/0064373).

8. Genes that Confer Plant Digestibility.

(A) Altering the level of xylan present in the cell wall of a plant by modulating expression of xylan synthase (U.S. Pat. No. 8,173,866).

In some embodiment the stacked trait may be a trait or event that has received regulatory approval including but not limited to the events with regulatory approval that are well known to one skilled in the art and can be found at the Center for Environmental Risk Assessment (cera-gmc.org/?action=gm_crop_database, which can be accessed using the www prefix) and at the International Service for the Acquisition of Agri-Biotech Applications (isaaa.org/gmapprovaldatabase/default.asp, which can be accessed using the www prefix).

Gene Silencing

In some embodiments the stacked trait may be in the form of silencing of one or more polynucleotides of interest resulting in suppression of one or more target pest polypeptides. In some embodiments the silencing is achieved through the use of a suppression DNA construct.

In some embodiments one or more polynucleotide encoding the polypeptides of the IPD090 polypeptide or fragments or variants thereof may be stacked with one or more polynucleotides encoding one or more polypeptides having insecticidal activity or agronomic traits as set forth supra and optionally may further include one or more polynucleotides providing for gene silencing of one or more target polynucleotides as discussed infra.

"Suppression DNA construct" is a recombinant DNA construct which when transformed or stably integrated into the genome of the plant, results in "silencing" of a target gene in the plant. The target gene may be endogenous or transgenic to the plant. "Silencing," as used herein with respect to the target gene, refers generally to the suppression of levels of mRNA or protein/enzyme expressed by the target gene, and/or the level of the enzyme activity or protein functionality. The term "suppression" includes lower, reduce, decline, decrease, inhibit, eliminate and prevent. "Silencing" or "gene silencing" does not specify mechanism and is inclusive, and not limited to, anti-sense, cosuppression, viral-suppression, hairpin suppression, stem-loop suppression, RNAi-based approaches and small RNA-based approaches.

A suppression DNA construct may comprise a region derived from a target gene of interest and may comprise all or part of the nucleic acid sequence of the sense strand (or antisense strand) of the target gene of interest. Depending upon the approach to be utilized, the region may be 100% identical or less than 100% identical (e.g., at least 50% or any integer between 51% and 100% identical) to all or part of the sense strand (or antisense strand) of the gene of interest.

Suppression DNA constructs are well-known in the art, are readily constructed once the target gene of interest is selected, and include, without limitation, cosuppression constructs, antisense constructs, viral-suppression constructs, hairpin suppression constructs, stem-loop suppression constructs, double-stranded RNA-producing constructs, and more generally, RNAi (RNA interference) constructs and small RNA constructs such as siRNA (short interfering RNA) constructs and miRNA (microRNA) constructs.

"Antisense inhibition" refers to the production of antisense RNA transcripts capable of suppressing the expression of the target protein.

"Antisense RNA" refers to an RNA transcript that is complementary to all or part of a target primary transcript or mRNA and that blocks the expression of a target isolated nucleic acid fragment. The complementarity of an antisense RNA may be with any part of the specific gene transcript, i.e., at the 5' non-coding sequence, 3' non-coding sequence, introns or the coding sequence.

"Cosuppression" refers to the production of sense RNA transcripts capable of suppressing the expression of the target protein. "Sense" RNA refers to RNA transcript that includes the mRNA and can be translated into protein within a cell or in vitro. Cosuppression constructs in plants have been previously designed by focusing on overexpression of a nucleic acid sequence having homology to a native mRNA, in the sense orientation, which results in the reduction of all RNA having homology to the overexpressed sequence (see, Vaucheret, et al., (1998) *Plant J.* 16:651-659 and Gura, (2000) *Nature* 404:804-808).

Another variation describes the use of plant viral sequences to direct the suppression of proximal mRNA encoding sequences (PCT Publication WO 1998/36083).

Recent work has described the use of "hairpin" structures that incorporate all or part, of an mRNA encoding sequence in a complementary orientation that results in a potential "stem-loop" structure for the expressed RNA (PCT Publication WO 1999/53050). In this case the stem is formed by polynucleotides corresponding to the gene of interest inserted in either sense or anti-sense orientation with respect to the promoter and the loop is formed by some polynucleotides of the gene of interest, which do not have a complement in the construct. This increases the frequency of cosuppression or silencing in the recovered transgenic plants. For review of hairpin suppression, see, Wesley, et al., (2003) Methods in Molecular Biology, Plant Functional Genomics: Methods and Protocols 236:273-286.

A construct where the stem is formed by at least 30 nucleotides from a gene to be suppressed and the loop is formed by a random nucleotide sequence has also effectively been used for suppression (PCT Publication WO 1999/61632).

The use of poly-T and poly-A sequences to generate the stem in the stem-loop structure has also been described (PCT Publication WO 2002/00894).

Yet another variation includes using synthetic repeats to promote formation of a stem in the stem-loop structure. Transgenic organisms prepared with such recombinant DNA fragments have been shown to have reduced levels of the protein encoded by the nucleotide fragment forming the loop as described in PCT Publication WO 2002/00904.

RNA interference refers to the process of sequence-specific post-transcriptional gene silencing in animals mediated by short interfering RNAs (siRNAs) (Fire, et al., (1998) *Nature* 391:806). The corresponding process in plants is commonly referred to as post-transcriptional gene silencing (PTGS) or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla (Fire, et al., (1999) *Trends Genet.* 15:358). Such protection from foreign gene expression may have evolved in response to the production of double-stranded RNAs (dsRNAs) derived from viral infection or from the random integration of transposon elements into a host genome via a cellular response that specifically destroys homologous single-stranded RNA of viral genomic RNA. The presence of dsRNA in cells triggers the RNAi response through a mechanism that has yet to be fully characterized.

The presence of long dsRNAs in cells stimulates the activity of a ribonuclease III enzyme referred to as dicer. Dicer is involved in the processing of the dsRNA into short pieces of dsRNA known as short interfering RNAs (siRNAs) (Berstein, et al., (2001) *Nature* 409:363). Short interfering RNAs derived from dicer activity are typically about 21 to about 23 nucleotides in length and comprise about 19 base pair duplexes (Elbashir, et aL, (2001) *Genes Dev.* 15:188). Dicer has also been implicated in the excision of 21- and 22-nucleotide small temporal RNAs (stRNAs) from precursor RNA of conserved structure that are implicated in translational control (Hutvagner, et al., (2001) *Science* 293:834). The RNAi response also features an endonuclease complex, commonly referred to as an RNA-induced silencing complex (RISC), which mediates cleavage of single-stranded RNA having sequence complementarity to the antisense strand of the siRNA duplex. Cleavage of the target RNA takes place in the middle of the region complementary to the antisense strand of the siRNA duplex (Elbashir, et al., (2001) *Genes Dev.* 15:188). In addition, RNA interference can also involve small RNA (e.g., miRNA) mediated gene silencing, presumably through cellular mechanisms that regulate chromatin structure and thereby prevent transcription of target gene sequences (see, e.g., Allshire, (2002) *Science* 297:1818-1819; Volpe, et al., (2002) *Science* 297:1833-1837; Jenuwein, (2002) *Science* 297:2215-2218 and Hall, et al., (2002) *Science* 297:2232-2237). As such, miRNA molecules of the disclosure can be used to mediate gene silencing via interaction with RNA transcripts or alternately by interaction with particular gene sequences, wherein such interaction results in gene silencing either at the transcriptional or post-transcriptional level.

Methods and compositions are further provided which allow for an increase in RNAi produced from the silencing element. In such embodiments, the methods and compositions employ a first polynucleotide comprising a silencing element for a target pest sequence operably linked to a promoter active in the plant cell; and, a second polynucleotide comprising a suppressor enhancer element comprising the target pest sequence or an active variant or fragment thereof operably linked to a promoter active in the plant cell. The combined expression of the silencing element with suppressor enhancer element leads to an increased amplification of the inhibitory RNA produced from the silencing element over that achievable with only the expression of the silencing element alone. In addition to the increased amplification of the specific RNAi species itself, the methods and compositions further allow for the production of a diverse population of RNAi species that can enhance the effectiveness of disrupting target gene expression. As such, when the suppressor enhancer element is expressed in a plant cell in combination with the silencing element, the methods and composition can allow for the systemic production of RNAi throughout the plant; the production of greater amounts of RNAi than would be observed with just the silencing element construct alone; and, the improved loading of RNAi into the phloem of the plant, thus providing better control of phloem feeding insects by an RNAi approach. Thus, the various methods and compositions provide improved methods for the delivery of inhibitory RNA to the target organism. See, for example, US Patent Application Publication 2009/0188008.

As used herein, a "suppressor enhancer element" comprises a polynucleotide comprising the target sequence to be suppressed or an active fragment or variant thereof. It is recognized that the suppressor enhancer element need not be identical to the target sequence, but rather, the suppressor enhancer element can comprise a variant of the target sequence, so long as the suppressor enhancer element has sufficient sequence identity to the target sequence to allow for an increased level of the RNAi produced by the silencing element over that achievable with only the expression of the silencing element. Similarly, the suppressor enhancer element can comprise a fragment of the target sequence, wherein the fragment is of sufficient length to allow for an increased level of the RNAi produced by the silencing element over that achievable with only the expression of the silencing element.

It is recognized that multiple suppressor enhancer elements from the same target sequence or from different target sequences or from different regions of the same target sequence can be employed. For example, the suppressor enhancer elements employed can comprise fragments of the target sequence derived from different region of the target sequence (i.e., from the 3'UTR, coding sequence, intron, and/or 5'UTR). Further, the suppressor enhancer element can be contained in an expression cassette, as described elsewhere herein, and in specific embodiments, the suppressor enhancer element is on the same or on a different DNA vector or construct as the silencing element. The suppressor enhancer element can be operably linked to a promoter as disclosed herein. It is recognized that the suppressor enhancer element can be expressed constitutively or alternatively, it may be produced in a stage-specific manner employing the various inducible or tissue-preferred or developmentally regulated promoters that are discussed elsewhere herein.

In specific embodiments, employing both a silencing element and the suppressor enhancer element the systemic production of RNAi occurs throughout the entire plant. In further embodiments, the plant or plant parts of the disclosure have an improved loading of RNAi into the phloem of the plant than would be observed with the expression of the silencing element construct alone and, thus provide better control of phloem feeding insects by an RNAi approach. In specific embodiments, the plants, plant parts and plant cells of the disclosure can further be characterized as allowing for the production of a diversity of RNAi species that can enhance the effectiveness of disrupting target gene expression.

In specific embodiments, the combined expression of the silencing element and the suppressor enhancer element increases the concentration of the inhibitory RNA in the plant cell, plant, plant part, plant tissue or phloem over the level that is achieved when the silencing element is expressed alone.

As used herein, an "increased level of inhibitory RNA" comprises any statistically significant increase in the level of RNAi produced in a plant having the combined expression when compared to an appropriate control plant. For example, an increase in the level of RNAi in the plant, plant part or the plant cell can comprise at least about a 1%, about a 1%-5%, about a 5%-10%, about a 10%-20%, about a 20%-30%, about a 30%-40%, about a 40%-50%, about a 50%-60%, about 60-70%, about 70%-80%, about a 80%-90%, about a 90%-100% or greater increase in the level of RNAi in the plant, plant part, plant cell or phloem when compared to an appropriate control. In other embodiments, the increase in the level of RNAi in the plant, plant part, plant cell or phloem can comprise at least about a 1 fold, about a 1 fold-5 fold, about a 5 fold-10 fold, about a 10 fold-20 fold, about a 20 fold-30 fold, about a 30 fold-40 fold, about a 40 fold-50 fold, about a 50 fold-60 fold, about 60 fold-70 fold, about 70 fold-80 fold, about a 80 fold-90 fold, about a 90 fold-100 fold or greater increase in the level of RNAi in the plant, plant part, plant cell or phloem when compared to an appropriate control. Examples of combined expression of the silencing element with suppressor enhancer element for the control of Stinkbugs and *Lygus* can be found in US Patent Application Publication 2011/0301223 and US Patent Application Publication 2009/0192117.

Some embodiments relate to down-regulation of expression of target genes in insect pest species by interfering ribonucleic acid (RNA) molecules. PCT Publication WO 2007/074405 describes methods of inhibiting expression of target genes in invertebrate pests including Colorado potato beetle. PCT Publication WO 2005/110068 describes methods of inhibiting expression of target genes in invertebrate pests including in particular Western corn rootworm as a means to control insect infestation. Furthermore, PCT Publication WO 2009/091864 describes compositions and methods for the suppression of target genes from insect pest species including pests from the *Lygus* genus. Nucleic acid molecules including RNAi for targeting the vacuolar ATPase H subunit, useful for controlling a coleopteran pest population and infestation as described in US Patent Application Publication 2012/0198586. PCT Publication WO 2012/055982 describes ribonucleic acid (RNA or double stranded RNA) that inhibits or down regulates the expression of a target gene that encodes: an insect ribosomal protein such as the ribosomal protein L19, the ribosomal protein L40 or the ribosomal protein S27A; an insect proteasome subunit such as the Rpn6 protein, the Pros 25, the Rpn2 protein, the proteasome beta 1 subunit protein or the Pros beta 2 protein; an insect β-coatomer of the COPI vesicle, the γ-coatomer of the COPI vesicle, the β'-coatomer protein or the ζ-coatomer of the COPI vesicle; an insect Tetraspanine 2 A protein which is a putative transmembrane domain protein; an insect protein belonging to the actin family such as Actin 5C; an insect ubiquitin-5E protein; an insect Sec23 protein which is a GTPase activator involved in intracellular protein transport; an insect crinkled protein which is an unconventional myosin which is involved in motor activity; an insect crooked neck protein which is involved in the regulation of nuclear alternative mRNA splicing; an insect vacuolar H+-ATPase G-subunit protein and an insect Tbp-1 such as Tat-binding protein. PCT publication WO 2007/035650 describes ribonucleic acid (RNA or double stranded RNA) that inhibits or down regulates the expression of a target gene that encodes Snf7. US Patent Application publication 20150176009 describes polynucleotide silencing elements targeting Rnapii-140 that confer resistance to coleopteran pests. US Patent Application publication 2011/0054007 describes polynucleotide silencing elements targeting RPS10. US Patent Application publication 2014/0275208 and US2015/0257389 describes polynucleotide silencing elements targeting RyanR and PAT3. US Patent Application Publications 2012/029750, US 20120297501, and 2012/0322660 describe interfering ribonucleic acids (RNA or double stranded RNA) that functions upon uptake by an insect pest species to down-regulate expression of a target gene in said insect pest, wherein the RNA comprises at least one silencing element wherein the silencing element is a region of double-stranded RNA comprising annealed complementary strands, one strand of which comprises or consists of a sequence of nucleotides which is at least partially complementary to a target nucleotide sequence within the target gene. US Patent Application Publication 2012/0164205 describe potential targets for interfering double stranded ribonucleic acids for inhibiting invertebrate pests including: a Chd3 Homologous Sequence, a Beta-Tubulin Homologous Sequence, a 40 kDa V-ATPase Homologous Sequence, a EF1α Homologous Sequence, a 26S Proteosome Subunit p28 Homologous Sequence, a Juvenile Hormone Epoxide Hydrolase Homologous Sequence, a Swelling Dependent Chloride Channel Protein Homologous Sequence, a Glucose-6-Phosphate 1-Dehydrogenase Protein Homologous Sequence, an Act42A Protein Homologous Sequence, a ADP-Ribosylation Factor 1 Homologous Sequence, a Transcription Factor IIB Protein Homologous Sequence, a Chitinase Homologous Sequences, a Ubiquitin Conjugating Enzyme Homologous Sequence, a Glyceraldehyde-3-Phosphate Dehydrogenase Homologous Sequence, an Ubiquitin B Homologous Sequence, a Juvenile Hormone Esterase Homolog, and an Alpha Tubuliln Homologous Sequence.

Use in Pesticidal Control

General methods for employing strains comprising a nucleic acid sequence of the embodiments or a variant thereof, in pesticide control or in engineering other organisms as pesticidal agents are known in the art.

Microorganism hosts that are known to occupy the "phytosphere" (phylloplane, phyllosphere, rhizosphere, and/or rhizoplana) of one or more crops of interest may be selected. These microorganisms are selected so as to be capable of successfully competing in the particular environment with the wild-type microorganisms, provide for stable maintenance and expression of the gene expressing the IPD090 polypeptide and desirably provide for improved protection of the pesticide from environmental degradation and inactivation.

Alternatively, the IPD090 polypeptide is produced by introducing a heterologous gene into a cellular host. Expression of the heterologous gene results, directly or indirectly, in the intracellular production and maintenance of the pesticide. These cells are then treated under conditions that prolong the activity of the toxin produced in the cell when the cell is applied to the environment of target pest(s). The resulting product retains the toxicity of the toxin. These naturally encapsulated IPD090 polypeptides may then be formulated in accordance with conventional techniques for application to the environment hosting a target pest, e.g., soil, water, and foliage of plants. See, for example EPA 0192319, and the references cited therein.

Pesticidal Compositions

In some embodiments the active ingredients can be applied in the form of compositions and can be applied to the crop area or plant to be treated, simultaneously or in succession, with other compounds. These compounds can be fertilizers, weed killers, Cryoprotectants, surfactants, detergents, pesticidal soaps, dormant oils, polymers, and/or time-release or biodegradable carrier formulations that permit long-term dosing of a target area following a single application of the formulation. They can also be selective herbicides, chemical insecticides, virucides, microbicides, amoebicides, pesticides, fungicides, bacteriocides, nematocides, molluscicides or mixtures of several of these preparations, if desired, together with further agriculturally acceptable carriers, surfactants or application-promoting adjuvants customarily employed in the art of formulation. Suitable carriers and adjuvants can be solid or liquid and correspond to the substances ordinarily employed in formulation technology, e.g. natural or regenerated mineral substances, solvents, dispersants, wetting agents, tackifiers, binders or fertilizers. Likewise the formulations may be prepared into edible "baits" or fashioned into pest "traps" to permit feeding or ingestion by a target pest of the pesticidal formulation.

Methods of applying an active ingredient or an agro-chemical composition that contains at least one of the IPD090 polypeptide produced by the bacterial strains include leaf application, seed coating and soil application. The number of applications and the rate of application depend on the intensity of infestation by the corresponding pest.

The composition may be formulated as a powder, dust, pellet, granule, spray, emulsion, colloid, solution or such like, and may be prepared by such conventional means as desiccation, lyophilization, homogenation, extraction, filtration, centrifugation, sedimentation or concentration of a culture of cells comprising the polypeptide. In all such compositions that contain at least one such pesticidal polypeptide, the polypeptide may be present in a concentration of from about 1% to about 99% by weight.

Lepidopteran, Dipteran, Heteropteran, nematode, Hemiptera or Coleopteran pests may be killed or reduced in numbers in a given area by the methods of the disclosure or may be prophylactically applied to an environmental area to prevent infestation by a susceptible pest. Preferably the pest ingests or is contacted with, a pesticidally-effective amount of the polypeptide. "Pesticidally-effective amount" as used herein refers to an amount of the pesticide that is able to bring about death to at least one pest or to noticeably reduce pest growth, feeding or normal physiological development. This amount will vary depending on such factors as, for example, the specific target pests to be controlled, the specific environment, location, plant, crop or agricultural site to be treated, the environmental conditions and the method, rate, concentration, stability, and quantity of application of the pesticidally-effective polypeptide composition. The formulations may also vary with respect to climatic conditions, environmental considerations, and/or frequency of application and/or severity of pest infestation.

The pesticide compositions described may be made by formulating either the bacterial cell, Crystal and/or spore suspension or isolated protein component with the desired agriculturally-acceptable carrier. The compositions may be formulated prior to administration in an appropriate means such as lyophilized, freeze-dried, desiccated or in an aqueous carrier, medium or suitable diluent, such as saline or other buffer. The formulated compositions may be in the form of a dust or granular material or a suspension in oil (vegetable or mineral) or water or oil/water emulsions or as a wettable powder or in combination with any other carrier material suitable for agricultural application. Suitable agricultural carriers can be solid or liquid and are well known in the art. The term "agriculturally-acceptable carrier" covers all adjuvants, inert components, dispersants, surfactants, tackifiers, binders, etc. that are ordinarily used in pesticide formulation technology; these are well known to those skilled in pesticide formulation. The formulations may be mixed with one or more solid or liquid adjuvants and prepared by various means, e.g., by homogeneously mixing, blending and/or grinding the pesticidal composition with suitable adjuvants using conventional formulation techniques. Suitable formulations and application methods are described in U.S. Pat. No. 6,468,523, herein incorporated by reference. The plants can also be treated with one or more chemical compositions, including one or more herbicide, insecticides or fungicides. Exemplary chemical compositions include: Fruits/Vegetables Herbicides: Atrazine, Bromacil, Diuron, Glyphosate, Linuron, Metribuzin, Simazine, Trifluralin, Fluazifop, Glufosinate, Halo sulfuron Gowan, Paraquat, Propyzamide, Sethoxydim, Butafenacil, Halosulfuron, Indaziflam; Fruits/Vegetables Insecticides: Aldicarb, *Bacillus thuriengiensis*, Carbaryl, Carbofuran, Chlorpyrifos, Cypermethrin, Deltamethrin, Diazinon, Malathion, Abamectin, Cyfluthrin/beta-cyfluthrin, Esfenvalerate, Lambda-cyhalothrin, Acequinocyl, Bifenazate, Methoxyfenozide, Novaluron, Chromafenozide, Thiacloprid, Dinotefuran, FluaCrypyrim, Tolfenpyrad, Clothianidin, Spirodiclofen, Gamma-cyhalothrin, Spiromesifen, Spinosad, Rynaxypyr, Cyazypyr, Spinoteram, Triflumuron, Spirotetramat, Imidacloprid, Flubendiamide, Thiodicarb, Metaflumizone, Sulfoxaflor, Cyflumetofen, Cyanopyrafen, Imidacloprid, Clothianidin, Thiamethoxam, Spinotoram, Thiodicarb, Flonicamid, Methiocarb, Emamectin-benzoate, Indoxacarb, Forthiazate, Fenamiphos, Cadusaphos, Pyriproxifen, Fenbutatin-oxid, Hexthiazox, Methomyl, 4-[[(6-Chlorpyridin-3-yl)methyl](2,2-difluorethyl)amino]furan-2(5H)-on; Fruits/Vegetables Fungicides: Carbendazim, Chlorothalonil, EBDCs, Sulphur, Thiophanate-methyl, Azoxystrobin, Cymoxanil, Fluazinam, Fosetyl, Iprodione, Kresoxim-methyl, Metalaxyl/mefenoxam, Trifloxystrobin, Ethaboxam, Iprovalicarb, Trifloxystrobin, Fenhexamid, Oxpoconazole fumarate, Cyazofamid, Fenamidone, Zoxamide, Zorvec™, Picoxystrobin, Pyraclostrobin, Cyflufenamid, Boscalid; Cereals Herbicides: Isoproturon, Bromoxynil, Ioxynil, Phenoxies, Chlorsulfuron, Clodinafop, Diclofop, Diflufenican, Fenoxaprop, Florasulam, Fluoroxypyr, Metsulfuron, Triasulfuron, Flucarbazone, Iodosulfuron, Propoxycarbazone, Picolinafen, Mesosulfuron, Beflubutamid, Pinoxaden, Amidosulfuron, Thifensulfuron Methyl, Tribenuron, Flupyrsulfuron, Sulfosulfuron, Pyrasulfotole, Pyroxsulam, Flufenacet, Tralkoxydim, Pyroxasulfon; Cereals Fungicides: Carbendazim, Chlorothalonil, Azoxystrobin, Cyproconazole, Cyprodinil, Fenpropimorph, Epoxiconazole, Kresoxim-methyl, Quinoxyfen, Tebuconazole, Trifloxystrobin, Simeconazole, Picoxystrobin, Pyraclostrobin, Dimoxystrobin, Prothioconazole, Fluoxastrobin; Cereals Insecticides: Dimethoate, Lambda-cyhalthrin, Deltamethrin, alpha-Cypermethrin, β-cyfluthrin, Bifenthrin, Imidacloprid, Clothianidin, Thiamethoxam, Thiacloprid, Acetamiprid, Dinetofuran, Clorphyriphos, Metamidophos, Oxidemethon-methyl, Pirimicarb, Methiocarb; Maize Herbicides: Atrazine, Alachlor, Bromoxynil, Acetochlor, Dicamba, Clopyralid, (S-) Dimethenamid, Glufosinate, Glyphosate, Isoxaflutole, (S-)Metolachlor, Mesotrione, Nicosulfuron, Primisulfuron, Revulin Q®; in Rimsulfuron, Sulcotrione, Foramsulfuron, Topramezone, Tembotrione, Saflufenacil, Thiencarbazone, Flufenacet, Pyroxasulfon; Maize Insecticides: Carbofuran, Chlorpyrifos, Bifenthrin, Fipronil, Imidacloprid, Lambda-Cyhalothrin, Tefluthrin, Terbufos, Thiamethoxam, Clothianidin, Spiromesifen, Flubendiamide, Triflumuron, Rynaxypyr, Deltamethrin, Thiodicarb, β-Cyfluthrin, Cypermethrin, Bifenthrin, Lufenuron, Triflumoron, Tefluthrin, Tebupirimphos, Ethiprole, Cyazypyr, Thiacloprid, Acetamiprid, Dinetofuran, Avermectin, Methiocarb, Spirodiclofen, Spirotetramat; Maize Fungicides: Fenitropan, Thiram, Prothioconazole, Tebuconazole, Trifloxystrobin; Rice Herbicides: Butachlor, Propanil, Azimsulfuron, Bensulfuron, Cyhalofop, Daimuron, Fentrazamide, Imazosulfuron, Mefenacet, Oxaziclomefone, Pyrazosulfuron, Pyributicarb, Quinclorac, Thiobencarb, Indanofan, Flufenacet, Fentrazamide, Halosulfuron, Oxaziclomefone, Benzobicyclon, Pyriftalid, Penoxsulam, Bispyribac, Oxadiargyl, Ethoxysulfuron, Pretilachlor, Mesotrione, Tefuryltrione, Oxadiazone, Fenoxaprop, Pyrimisulfan; Rice Insecticides: Diazinon, Fenitrothion, Fenobucarb, Monocrotophos, Benfuracarb, Buprofezin, Dinotefuran, Fipronil, Imidacloprid, Isoprocarb, Thiacloprid, Chromafenozide, Thiacloprid, Dinotefuran, Clothianidin, Ethiprole, Flubendiamide, Rynaxypyr, Deltamethrin, Acetamiprid, Thiamethoxam, Cyazypyr, Spinosad, Spinotoram, Emamectin-Benzoate, Cypermethrin, Chlorpyriphos, Cartap, Methamidophos, Etofenprox, Triazophos, 4-[[(6-Chlorpyridin-3-yl)methyl](2,2-difluorethyl)amino]furan-2(5H)-on, Carbofuran, Benfuracarb; Rice Fungicides: Thiophanate-methyl, Azoxystrobin, Carpropamid, Edifenphos, Ferimzone, Iprobenfos, Isoprothiolane, Pencycuron, Probenazole, Pyroquilon, Tricyclazole, Trifloxystrobin, Diclocymet, Fenoxanil, Simeconazole, Tiadinil; Cotton Herbicides: Diuron, Fluometuron, MSMA, Oxyfluorfen, Prometryn, Trifluralin, Carfentrazone, Clethodim, Fluazifop-butyl, Glyphosate, Norflurazon, Pendimethalin, Pyrithiobac-sodium, Trifloxysulfuron, Tepraloxydim, Glufosinate, Flumioxazin, Thidiazuron; Cotton Insecticides: Acephate, Aldicarb, Chlorpyrifos, Cypermethrin, Deltamethrin, Malathion, Monocrotophos, Abamectin, Acetamiprid, Emamectin Benzoate, Imidacloprid, Indoxacarb, Lambda-Cyhalothrin, Spinosad, Thiodicarb, Gamma-Cyhalothrin, Spiromesifen, Pyridalyl, Flonicamid, Flubendiamide, Triflumuron, Rynaxypyr, Beta-Cyfluthrin, Spirotetramat, Clothianidin, Thiamethoxam, Thiacloprid, Dinetofuran, Flubendiamide, Cyazypyr, Spinosad, Spinotoram, gamma Cyhalothrin, 4-[[(6-Chlorpyridin-3-yl)methyl](2,2-difluorethyl)amino]furan-2(5H)-on, Thiodicarb, Avermectin, Flonicamid, Pyridalyl, Spiromesifen, Sulfoxaflor, Profenophos, Thriazophos, Endosulfan; Cotton Fungicides: Etridiazole, Metalaxyl, Quintozene; Soybean Herbicides: Alachlor, Bentazone, Trifluralin, Chlorimuron-Ethyl, Cloransulam-Methyl, Fenoxaprop, Fomesafen, Fluazifop, Glyphosate, Imazamox, Imazaquin, Imazethapyr, (S-)Metolachlor, Metribuzin, Pendimethalin, Tepraloxydim, Glufosinate; Soybean Insecticides: Lambda-cyhalothrin, Methomyl, Parathion, Thiocarb, Imidacloprid, Clothianidin, Thiamethoxam, Thiacloprid, Acetamiprid, Dinetofuran, Flubendiamide, Rynaxypyr, Cyazypyr, Spinosad, Spinotoram, Emamectin-Benzoate, Fipronil, Ethiprole, Deltamethrin, β-Cyfluthrin, gamma and lambda Cyhalothrin, 4-[[(6-Chlorpyridin-3-yl)methyl](2,2-difluorethyl)amino]furan-2 (5H)-on, Spirotetramat, Spinodiclofen, Triflumuron, Flonicamid, Thiodicarb, beta-Cyfluthrin; Soybean Funqicides: Azoxystrobin, Cyproconazole, Epoxiconazole, Flutriafol, Pyraclostrobin, Tebuconazole, Trifloxystrobin, Prothioconazole, Tetraconazole; Sugarbeet Herbicides: Chloridazon, Desmedipham, Ethofumesate, Phenmedipham, Triallate, Clopyralid, Fluazifop, Lenacil, Metamitron, Quinmerac, Cycloxydim, Triflusulfuron, Tepraloxydim, Quizalofop; Sugarbeet Insecticides: Imidacloprid, Clothianidin, Thiamethoxam, Thiacloprid, Acetamiprid, Dinetofuran, Deltamethrin, β-Cyfluthrin, gamma/lambda Cyhalothrin, 4-[[(6-Chlorpyridin-3-yl)methyl](2,2-difluorethyl)amino]furan-2(5H)-on, Tefluthrin, Rynaxypyr, Cyaxypyr, Fipronil, Carbofuran; Canola Herbicides: Clopyralid, Diclofop, Fluazifop, Glufosinate, Glyphosate, Metazachlor, Trifluralin Ethametsulfuron, Quinmerac, Quizalofop, Clethodim, Tepraloxydim; Canola Fungicides: Azoxystrobin, Carbendazim, Fludioxonil, Iprodione, Prochloraz, Vinclozolin; Canola Insecticides: Carbofuran organophosphates, Pyrethroids, Thiacloprid, Deltamethrin, Imidacloprid, Clothianidin, Thiamethoxam, Acetamiprid, Dinetofuran, β-Cyfluthrin, gamma and lambda Cyhalothrin, tau-Fluvaleriate, Ethiprole, Spinosad, Spinotoram, Flubendiamide, Rynaxypyr, Cyazypyr, 4-[[(6-Chlorpyridin-3-yl)methyl](2,2-difluorethyl)amino]furan-2(5H)-on.

In some embodiments the herbicide is Atrazine, Bromacil, Diuron, Chlorsulfuron, Metsulfuron, Thifensulfuron Methyl, Tribenuron, Acetochlor, Dicamba, Isoxaflutole, Nicosulfuron, Rimsulfuron, Pyrithiobac-sodium, Flumioxazin, Chlorimuron-Ethyl, Metribuzin, Quizalofop, S-metolachlor, Hexazinne or combinations thereof.

In some embodiments the insecticide is Esfenvalerate, Chlorantraniliprole, Methomyl, Indoxacarb, Oxamyl or combinations thereof.

Pesticidal and Insecticidal Activity

"Pest" includes but is not limited to, insects, fungi, bacteria, nematodes, mites, ticks and the like. Insect pests include insects selected from the orders Coleoptera, Diptera, Hymenoptera, *Lepidoptera*, Mallophaga, Homoptera, Hemiptera Orthroptera, Thysanoptera, Dermaptera, Isoptera, Anoplura, Siphonaptera, Trichoptera, etc., particularly *Lepidoptera* and Coleoptera.

Those skilled in the art will recognize that not all compounds are equally effective against all pests. Compounds of the embodiments display activity against insect pests, which may include economically important agronomic, forest, greenhouse, nursery ornamentals, food and fiber, public and animal health, domestic and commercial structure, household and stored product pests.

Larvae of the order *Lepidoptera* include, but are not limited to, armyworms, cutworms, loopers and heliothines in the family Noctuidae *Spodoptera frugiperda* JE Smith (fall armyworm); *S. exigua* Hübner (beet armyworm); *S. litura* Fabricius (tobacco cutworm, cluster caterpillar); *Mamestra configurata* Walker (bertha armyworm); *M. brassicae* Linnaeus (cabbage moth); *Agrotis ipsilon* Hufnagel (black cutworm); *A. orthogonia* Morrison (western cutworm); *A. subterranea* Fabricius (granulate cutworm); *Alabama argillacea* Hübner (cotton leaf worm); *Trichoplusia ni* Hübner (cabbage looper); *Pseudoplusia includens* Walker (soybean looper); *Anticarsia gemmatalis* Hübner (velvetbean caterpillar); *Hypena scabra* Fabricius (green cloverworm); *Heliothis virescens* Fabricius (tobacco budworm); *Pseudaletia unipuncta* Haworth (armyworm); *Athetis mindara* Barnes and Mcdunnough (rough skinned cutworm); *Euxoa messoria* Harris (darksided cutworm); *Earias insulana* Boisduval (spiny bollworm); *E. vittella* Fabricius (spotted bollworm); *Helicoverpa armigera* Hübner (American bollworm); *H. zea* Boddie (corn earworm or cotton bollworm); *Melanchra picta* Harris (zebra caterpillar); *Egira* (Xylomyges) *curialis* Grote (citrus cutworm); borers, casebearers, webworms, coneworms, and skeletonizers from the family Pyralidae *Ostrinia nubilalis* Hübner (European corn borer); *Amyelois transitella* Walker (naval orangeworm); *Anagasta kuehniella* Zeller (Mediterranean flour moth); *Cadra cautella* Walker (almond moth); *Chilo suppressalis* Walker (rice stem borer); *C. partellus*, (sorghum borer); *Corcyra cephalonica* Stainton (rice moth); *Crambus caliginosellus* Clemens (corn root webworm); *C. teterrellus* Zincken (bluegrass webworm); *Cnaphalocrocis medinalis* Guenée (rice leaf roller); *Desmia funeralis* Hübner (grape leaffolder); *Diaphania hyalinata* Linnaeus (melon worm); *D. nitidalis* Stoll (pickleworm); *Diatraea grandiosella* Dyar (southwestern corn borer), *D. saccharalis* Fabricius (surgarcane borer); *Eoreuma loftini* Dyar (Mexican rice borer); *Ephestia elutella* Hübner (tobacco (cacao) moth); *Galleria mellonella* Linnaeus (greater wax moth); *Herpetogramma licarsisalis* Walker (sod webworm); *Homoeosoma electellum* Hulst (sunflower moth); *Elasmopalpus lignosellus* Zeller (lesser cornstalk borer); *Achroia grisella* Fabricius (lesser wax moth); *Loxostege sticticalis* Linnaeus (beet webworm); *Orthaga thyrisalis* Walker (tea tree web moth); *Maruca testulalis* Geyer (bean pod borer); *Plodia interpunctella* Hübner (Indian meal moth); *Scirpophaga incertulas* Walker (yellow stem borer); *Udea rubigalis* Guenée (celery leaftier); and leafrollers, budworms, seed worms and fruit worms in the family Tortricidae *Acleris gloverana* Walsingham (Western blackheaded budworm); *A. variana* Fernald (Eastern blackheaded budworm); *Archips argyrospila* Walker (fruit tree leaf roller); *A. rosana* Linnaeus (European leaf roller); and other *Archips* species, *Adoxophyes orana* Fischer von Rösslerstamm (summer fruit *tortrix* moth); *Cochylis hospes* Walsingham (banded sunflower moth); *Cydia latiferreana* Walsingham (filbertworm); *C. pomonella* Linnaeus (coding moth); *Platynota flavedana* Clemens (variegated leafroller); *P. stultana* Walsingham (omnivorous leafroller); *Lobesia botrana* Denis & Schiffermüller (European grape vine moth); *Spilonota ocellana* Denis & Schiffermüller (eyespotted bud moth); *Endopiza viteana* Clemens (grape berry moth); *Eupoecilia ambiguella* Hübner (vine moth); *Bonagota salubricola* Meyrick (Brazilian apple leafroller); *Grapholita molesta* Busck (oriental fruit moth); *Suleima helianthana* Riley (sunflower bud moth); *Argyrotaenia* spp.; *Choristoneura* spp.

Selected other agronomic pests in the order *Lepidoptera* include, but are not limited to, *Alsophila pometaria* Harris (fall cankerworm); *Anarsia lineatella* Zeller (peach twig borer); *Anisota senatoria* J. E. Smith (orange striped oakworm); *Antheraea pernyi* Guérin-Méneville (Chinese Oak Tussah Moth); *Bombyx mori* Linnaeus (Silkworm); *Bucculatrix thurberiella* Busck (cotton leaf perforator); *Colias eurytheme* Boisduval (alfalfa caterpillar); *Datana inte-

*gerrima* Grote & Robinson (walnut caterpillar); *Dendrolimus sibiricus* Tschetwerikov (Siberian silk moth), *Ennomos subsignaria* Hübner (elm spanworm); *Erannis tiliaria* Harris (linden looper); *Euproctis chrysorrhoea* Linnaeus (browntail moth); *Harrisina americana* Guérin-Méneville (grapeleaf skeletonizer); *Hemileuca oliviae* Cockrell (range caterpillar); *Hyphantria cunea* Drury (fall webworm); *Keiferia lycopersicella* Walsingham (tomato pinworm); *Lambdina fiscellaria fiscellaria* Hulst (Eastern hemlock looper); *L. fiscellaria lugubrosa* Hulst (Western hemlock looper); *Leucoma salicis* Linnaeus (satin moth); *Lymantria dispar* Linnaeus (gypsy moth); *Manduca quinquemaculata* Haworth (five spotted hawk moth, tomato hornworm); *M. sexta* Haworth (tomato hornworm, tobacco hornworm); *Operophtera brumata* Linnaeus (winter moth); *Paleacrita vernata* Peck (spring cankerworm); *Papilio cresphontes* Cramer (giant swallowtail orange dog); *Phryganidia californica* Packard (California oakworm); *Phyllocnistis citrella* Stainton (citrus leafminer); *Phyllonorycter blancardella* Fabricius (spotted tentiform leafminer); *Pieris brassicae* Linnaeus (large white butterfly); *P. rapae* Linnaeus (small white butterfly); *P. napi* Linnaeus (green veined white butterfly); *Platyptilia carduidactyla* Riley (artichoke plume moth); *Plutella xylostella* Linnaeus (diamondback moth); *Pectinophora gossypiella* Saunders (pink bollworm); *Pontia protodice* Boisduval and Leconte (Southern cabbageworm); *Sabulodes aegrotata* Guenée (omnivorous looper); *Schizura concinna* J. E. Smith (red humped caterpillar); *Sitotroga cerealella* Olivier (Angoumois grain moth); *Thaumetopoea pityocampa* Schiffermuller (pine processionary caterpillar); *Tineola bisselliella* Hummel (webbing clothesmoth); *Tuta absoluta* Meyrick (tomato leafminer); *Yponomeuta padella* Linnaeus (ermine moth); *Heliothis subflexa* Guenée; *Malacosoma* spp. and *Orgyia* spp.

Of interest are larvae and adults of the order Coleoptera including weevils from the families Anthribidae, Bruchidae and Curculionidae (including, but not limited to: *Anthonomus grandis* Boheman (boll weevil); *Lissorhoptrus oryzophilus* Kuschel (rice water weevil); *Sitophilus granarius* Linnaeus (granary weevil); *S. oryzae* Linnaeus (rice weevil); *Hypera punctata* Fabricius (clover leaf weevil); *Cylindrocopturus adspersus* LeConte (sunflower stem weevil); *Smicronyx fulvus* LeConte (red sunflower seed weevil); *S. sordidus* LeConte (gray sunflower seed weevil); *Sphenophorus maidis* Chittenden (maize billbug)); flea beetles, cucumber beetles, rootworms, leaf beetles, potato beetles and leafminers in the family Chrysomelidae (including, but not limited to: *Leptinotarsa decemlineata* Say (Colorado potato beetle); *Diabrotica virgifera virgifera* LeConte (western corn rootworm); *D. barberi* Smith and Lawrence (northern corn rootworm); *D. undecimpunctata howardi* Barber (southern corn rootworm); *Chaetocnema pulicaria* Melsheimer (corn flea beetle); *Phyllotreta cruciferae* Goeze (Crucifer flea beetle); *Phyllotreta striolata* (stripped flea beetle); *Colaspis brunnea* Fabricius (grape colaspis); *Oulema melanopus* Linnaeus (cereal leaf beetle); *Zygogramma exclamationis* Fabricius (sunflower beetle)); beetles from the family Coccinellidae (including, but not limited to: *Epilachna varivestis* Mulsant (Mexican bean beetle)); chafers and other beetles from the family Scarabaeidae (including, but not limited to: *Popillia japonica* Newman (Japanese beetle); *Cyclocephala borealis* Arrow (northern masked chafer, white grub); *C. immaculata* Olivier (southern masked chafer, white grub); *Rhizotrogus majalis* Razoumowsky (European chafer); *Phyllophaga crinita* Burmeister (white grub); *Ligyrus gibbosus* De Geer (carrot beetle); carpet beetles from the family Dermestidae; wireworms from the family Elateridae, *Eleodes* spp., *Melanotus* spp.; *Conoderus* spp.; *Limonius* spp.; *Agriotes* spp.; *Ctenicera* spp.; *Aeolus* spp.; bark beetles from the family Scolytidae and beetles from the family Tenebrionidae.

Adults and immatures of the order Diptera are of interest, including leafminers *Agromyza parvicornis* Loew (corn blotch leafminer); midges (including, but not limited to: *Contarinia sorghicola* Coquillett (sorghum midge); *Mayetiola destructor* Say (Hessian fly); *Sitodiplosis mosellana* Géhin (wheat midge); *Neolasioptera murtfeldtiana* Felt, (sunflower seed midge)); fruit flies (Tephritidae), *Oscinella frit* Linnaeus (fruit flies); maggots (including, but not limited to: *Delia platura* Meigen (seedcorn maggot); *D. coarctata* Fallen (wheat bulb fly) and other *Delia* spp., *Meromyza americana* Fitch (wheat stem maggot); *Musca domestica* Linnaeus (house flies); *Fannia canicularis* Linnaeus, *F. femoralis* Stein (lesser house flies); *Stomoxys calcitrans* Linnaeus (stable flies)); face flies, horn flies, blow flies, *Chrysomya* spp.; *Phormia* spp. and other muscoid fly pests, horse flies *Tabanus* spp.; bot flies *Gastrophilus* spp.; *Oestrus* spp.; cattle grubs *Hypoderma* spp.; deer flies *Chrysops* spp.; *Melophagus ovinus* Linnaeus (keds) and other *Brachycera*, mosquitoes *Aedes* spp.; *Anopheles* spp.; *Culex* spp.; black flies *Prosimulium* spp.; *Simulium* spp.; biting midges, sand flies, sciarids, and other Nematocera.

Included as insects of interest are adults and nymphs of the orders Hemiptera and Homoptera such as, but not limited to, adelgids from the family Adelgidae, plant bugs from the family Miridae, cicadas from the family Cicadidae, leafhoppers, *Empoasca* spp.; from the family Cicadellidae, planthoppers from the families Cixiidae, Flatidae, Fulgoroidea, Issidae and Delphacidae, treehoppers from the family Membracidae, psyllids from the family Psyllidae, whiteflies from the family Aleyrodidae, aphids from the family Aphididae, phylloxera from the family Phylloxeridae, mealybugs from the family Pseudococcidae, scales from the families Asterolecanidae, Coccidae, Dactylopiidae, Diaspididae, Eriococcidae Ortheziidae, Phoenicococcidae and Margarodidae, lace bugs from the family Tingidae, stink bugs from the family Pentatomidae, cinch bugs, *Blissus* spp.; and other seed bugs from the family Lygaeidae, spittlebugs from the family Cercopidae squash bugs from the family Coreidae and red bugs and cotton stainers from the family Pyrrhocoridae.

Agronomically important members from the order Homoptera further include, but are not limited to: *Acyrthisiphon pisum* Harris (pea aphid); *Aphis craccivora* Koch (cowpea aphid); *A. fabae* Scopoli (black bean aphid); *A. gossypii* Glover (cotton aphid, melon aphid); *A. maidiradicis* Forbes (corn root aphid); *A. pomi* De Geer (apple aphid); *A. spiraecola* Patch (spirea aphid); *Aulacorthum solani* Kaltenbach (foxglove aphid); *Chaetosiphon fragaefolii* Cockerell (strawberry aphid); *Diuraphis noxia* Kurdjumov/Mordvilko (Russian wheat aphid); *Dysaphis plantaginea* Paaserini (rosy apple aphid); *Eriosoma lanigerum* Hausmann (woolly apple aphid); *Brevicoryne brassicae* Linnaeus (cabbage aphid); *Hyalopterus pruni* Geoffroy (mealy plum aphid); *Lipaphis erysimi* Kaltenbach (turnip aphid); *Metopolophium dirrhodum* Walker (cereal aphid); *Macrosiphum euphorbiae* Thomas (potato aphid); *Myzus persicae* Sulzer (peach-potato aphid, green peach aphid); *Nasonovia ribisnigri* Mosley (lettuce aphid); *Pemphigus* spp. (root aphids and gall aphids); *Rhopalosiphum maidis* Fitch (corn leaf aphid); *R. padi* Linnaeus (bird cherry-oat aphid); *Schizaphis graminum* Rondani (greenbug); *Sipha flava* Forbes (yellow sugarcane aphid); *Sitobion avenae* Fabricius (English grain aphid); *Therioaphis maculata* Buckton (spotted alfalfa aphid); *Toxoptera aurantii* Boyer de Fonscolombe (black citrus aphid) and *T. citricida* Kirkaldy (brown citrus aphid); *Adelges* spp. (adelgids); *Phylloxera devastatrix* Pergande (pecan phylloxera); *Bemisia tabaci* Gennadius (tobacco whitefly, sweetpotato whitefly); *B. argentifolii* Bellows & Perring (silverleaf whitefly); *Dialeurodes citri* Ashmead (citrus whitefly); *Trialeurodes abutiloneus* (bandedwinged whitefly) and *T. vaporariorum* Westwood (greenhouse whitefly); *Empoasca fabae* Harris (potato leafhopper); *Laodelphax striatellus* Fallen (smaller brown planthopper); *Macrolestes quadrilineatus* Forbes (aster leafhopper); *Nephotettix cinticeps* Uhler (green leafhopper); *N. nigropictus* Stål (rice leafhopper); *Nilaparvata lugens* Stål (brown planthopper); *Peregrinus maidis* Ashmead (corn planthopper); *Sogatella furcifera* Horvath (white-backed planthopper); *Sogatodes orizicola* Muir (rice delphacid); *Typhlocyba pomaria* McAtee (white apple leafhopper); *Erythroneoura* spp. (grape leafhoppers); *Magicicada septendecim* Linnaeus (periodical cicada); *Icerya purchasi* Maskell (cottony cushion scale); *Quadraspidiotus perniciosus* Comstock (San Jose scale); *Planococcus citri* Risso (citrus mealybug); *Pseudococcus* spp. (other mealybug complex); *Cacopsylla pyricola* Foerster (pear psylla); *Trioza diospyri* Ashmead (persimmon psylla).

Agronomically important species of interest from the order Hemiptera include, but are not limited to: *Acrosternum hilare* Say (green stink bug); *Anasa tristis* De Geer (squash bug); *Blissus leucopterus leucopterus* Say (chinch bug); *Corythuca gossypii* Fabricius (cotton lace bug); *Cyrtopeltis modesta* Distant (tomato bug); *Dysdercus suturellus* Herrich-Schiffer (cotton stainer); *Euschistus servus* Say (brown stink bug); *E. variolarius* Palisot de Beauvois (one-spotted stink bug); *Graptostethus* spp. (complex of seed bugs); *Leptoglossus corculus* Say (leaf-footed pine seed bug); *Lygus lineolaris* Palisot de Beauvois (tarnished plant bug); *L. Hesperus* Knight (Western tarnished plant bug); *L. pratensis* Linnaeus (common meadow bug); *L. rugulipennis* Poppius (European tarnished plant bug); *Lygocoris pabulinus* Linnaeus (common green capsid); *Nezara viridula* Linnaeus (southern green stink bug); *Oebalus pugnax* Fabricius (rice stink bug); *Oncopeltus fasciatus* Dallas (large milkweed bug); *Pseudatomoscelis seriatus* Reuter (cotton fleahopper).

Furthermore, embodiments may be effective against Hemiptera such, *Calocoris norvegicus* Gmelin (strawberry bug); *Orthops campestris* Linnaeus; *Plesiocoris rugicollis* Fallen (apple capsid); *Cyrtopeltis modestus* Distant (tomato bug); *Cyrtopeltis notatus* Distant (suckfly); *Spanagonicus albofasciatus* Reuter (whitemarked fleahopper); *Diaphnocoris chlorionis* Say (honeylocust plant bug); *Labopidicola allii* Knight (onion plant bug); *Pseudatomoscelis seriatus* Reuter (cotton fleahopper); *Adelphocoris rapidus* Say (rapid plant bug); *Poecilocapsus lineatus* Fabricius (four-lined plant bug); *Nysius ericae* Schilling (false chinch bug); *Nysius raphanus* Howard (false chinch bug); *Nezara viridula* Linnaeus (Southern green stink bug); *Eurygaster* spp.; Coreidae spp.; Pyrrhocoridae spp.; Tinidae spp.; Blostomatidae spp.; Reduviidae spp. and Cimicidae spp.

Also included are adults and larvae of the order Acari (mites) such as *Aceria tosichella* Keifer (wheat curl mite); *Petrobia latens* Müller (brown wheat mite); spider mites and red mites in the family Tetranychidae, *Panonychus ulmi* Koch (European red mite); *Tetranychus urticae* Koch (two spotted spider mite); (*T. mcdanieli* McGregor (McDaniel mite); *T. cinnabarinus* Boisduval (carmine spider mite); *T. turkestani* Ugarov & Nikolski (strawberry spider mite); flat mites in the family Tenuipalpidae, *Brevipalpus lewisi* McGregor (citrus flat mite); rust and bud mites in the family Eriophyidae and other foliar feeding mites and mites important in human and animal health, i.e., dust mites in the family Epidermoptidae, follicle mites in the family Demodicidae, grain mites in the family Glycyphagidae, ticks in the order Ixodidae. *Ixodes scapularis* Say (deer tick); *I. holocyclus* Neumann (Australian paralysis tick); *Dermacentor variabilis* Say (American dog tick); *Amblyomma americanum* Linnaeus (lone star tick) and scab and itch mites in the families Psoroptidae, Pyemotidae and Sarcoptidae.

Insect pests of the order Thysanura are of interest, such as *Lepisma saccharina* Linnaeus (silverfish); *Thermobia domestica* Packard (firebrat).

Additional arthropod pests covered include: spiders in the order Araneae such as *Loxosceles reclusa* Gertsch and Mulaik (brown recluse spider) and the *Latrodectus mactans* Fabricius (black widow spider) and centipedes in the order Scutigeromorpha such as *Scutigera coleoptrata* Linnaeus (house centipede).

Insect pest of interest include the superfamily of stink bugs and other related insects including but not limited to species belonging to the family Pentatomidae (*Nezara viridula, Halyomorpha halys, Piezodorus guildini, Euschistus servus, Acrosternum hilare, Euschistus heros, Euschistus tristigmus, Acrosternum hilare, Dichelops furcatus, Dichelops melacanthus*, and *Bagrada hilaris* (Bagrada Bug)), the family Plataspidae (*Megacopta cribraria*—Bean plataspid) and the family Cydnidae (*Scaptocoris castanea*—Root stink bug) and Lepidoptera species including but not limited to: diamond-back moth, e.g., *Helicoverpa zea* Boddie; soybean looper, e.g., *Pseudoplusia includens* Walker and velvet bean caterpillar e.g., *Anticarsia gemmatalis* Hübner.

Methods for measuring pesticidal activity are well known in the art. See, for example, Czapla and Lang, (1990) *J. Econ. Entomol.* 83:2480-2485; Andrews, et al., (1988) *Biochem. J.* 252:199-206; Marrone, et al., (1985) *J. of Economic Entomology* 78:290-293 and U.S. Pat. No. 5,743, 477, all of which are herein incorporated by reference in their entirety. Generally, the protein is mixed and used in feeding assays. See, for example Marrone, et al., (1985) *J. of Economic Entomology* 78:290-293. Such assays can include contacting plants with one or more pests and determining the plant's ability to survive and/or cause the death of the pests.

Nematodes include parasitic nematodes such as root-knot, cyst and lesion nematodes, including *Heterodera* spp., *Meloidogyne* spp. and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode) and *Globodera rostochiensis* and *Globodera pailida* (potato cyst nematodes). Lesion nematodes include *Pratylenchus* spp.

Seed Treatment

To protect and to enhance yield production and trait technologies, seed treatment options can provide additional crop plan flexibility and cost effective control against insects, weeds and diseases. Seed material can be treated, typically surface treated, with a composition comprising combinations of chemical or biological herbicides, herbicide safeners, insecticides, fungicides, germination inhibitors and enhancers, nutrients, plant growth regulators and activators, bactericides, nematocides, avicides and/or molluscicides. These compounds are typically formulated together with further carriers, surfactants or application-promoting adjuvants customarily employed in the art of formulation. The coatings may be applied by impregnating propagation material with a liquid formulation or by coating with a combined wet or dry formulation. Examples of the various types of compounds that may be used as seed treatments are provided in The Pesticide Manual: A World Compendium, C. D. S. Tomlin Ed., Published by the British Crop Production Council, which is hereby incorporated by reference.

Some seed treatments that may be used on crop seed include, but are not limited to, one or more of abscisic acid, acibenzolar-S-methyl, avermectin, amitrol, azaconazole, azospirillum, azadirachtin, azoxystrobin, *Bacillus* spp. (including one or more of *cereus, firmus, megaterium, pumilis, sphaericus, subtilis* and/or *thuringiensis* species), *bradyrhizobium* spp. (including one or more of *betae, canariense, elkanii, iriomotense, japonicum, liaonigense, pachyrhizi* and/or *yuanmingense*), captan, carboxin, chitosan, clothianidin, copper, cyazypyr, difenoconazole, etidiazole, fipronil, fludioxonil, fluoxastrobin, fluquinconazole, flurazole, fluxofenim, harpin protein, imazalil, imidacloprid, ipconazole, isoflavenoids, lipo-chitooligosaccharide, mancozeb, manganese, maneb, mefenoxam, metalaxyl, metconazole, myclobutanil, PCNB, penflufen, *penicillium*, penthiopyrad, permethrine, picoxystrobin, prothioconazole, pyraclostrobin, rynaxypyr, S-metolachlor, saponin, sedaxane, TCMTB, tebuconazole, thiabendazole, thiamethoxam, thiocarb, thiram, tolclofos-methyl, triadimenol, *trichoderma*, trifloxystrobin, triticonazole and/or zinc. PCNB seed coat refers to EPA Registration Number 00293500419, containing quintozen and terrazole. TCMTB refers to 2-(thiocyanomethylthio) benzothiazole.

Seed varieties and seeds with specific transgenic traits may be tested to determine which seed treatment options and application rates may complement such varieties and transgenic traits in order to enhance yield. For example, a variety with good yield potential but head smut susceptibility may benefit from the use of a seed treatment that provides protection against head smut, a variety with good yield potential but cyst nematode susceptibility may benefit from the use of a seed treatment that provides protection against cyst nematode, and so on. Likewise, a variety encompassing a transgenic trait conferring insect resistance may benefit from the second mode of action conferred by the seed treatment, a variety encompassing a transgenic trait conferring herbicide resistance may benefit from a seed treatment with a safener that enhances the plants resistance to that herbicide, etc. Further, the good root establishment and early emergence that results from the proper use of a seed treatment may result in more efficient nitrogen use, a better ability to withstand drought and an overall increase in yield potential of a variety or varieties containing a certain trait when combined with a seed treatment.

Methods for Killing an Insect Pest and Controlling an Insect Population

In some embodiments methods are provided for killing an insect pest, comprising contacting the insect pest, either simultaneously or sequentially, with an insecticidally-effective amount of a recombinant IPD090 polypeptide or IPD090 chimeric polypeptide of the disclosure. In some embodiments methods are provided for killing an insect pest, comprising contacting the insect pest with an insecticidally-effective amount of a recombinant pesticidal protein of SEQ ID NO: 2, SEQ ID NO: 4, SEQ ID NO: 6, SEQ ID NO: 379, SEQ ID NO: 384 or a variant thereof.

In some embodiments methods are provided for controlling an insect pest population, comprising contacting the insect pest population, either simultaneously or sequentially, with an insecticidally-effective amount of a recombinant IPD090 polypeptide or IPD090 chimeric polypeptide of the disclosure. In some embodiments methods are provided for controlling an insect pest population, comprising contacting the insect pest population with an insecticidally-effective amount of a recombinant IPD090 polypeptide of SEQ ID NO: 2, SEQ ID NO: 4, SEQ ID NO: 6, SEQ, SEQ ID NO: 379, SEQ ID NO: 384 or a variant thereof. As used herein, "controlling a pest population" or "controls a pest" refers to any effect on a pest that results in limiting the damage that the pest causes. Controlling a pest includes, but is not limited to, killing the pest, inhibiting development of the pest, altering fertility or growth of the pest in such a manner that the pest provides less damage to the plant, decreasing the number of offspring produced, producing less fit pests, producing pests more susceptible to predator attack or deterring the pests from eating the plant.

In some embodiments methods are provided for controlling an insect pest population resistant to a pesticidal protein, comprising contacting the insect pest population, either simultaneously or sequentially, with an insecticidally-effective amount of a recombinant IPD090 polypeptide or chimeric IPD090 polypeptide of the disclosure. In some embodiments methods are provided for controlling an insect pest population resistant to a pesticidal protein, comprising contacting the insect pest population with an insecticidally-effective amount of a recombinant IPD090 polypeptide of SEQ ID NO: 2, SEQ ID NO: 4, SEQ ID NO: 6, SEQ ID NO: 379, SEQ ID NO: 384 or a variant thereof.

In some embodiments methods are provided for protecting a plant from an insect pest, comprising expressing in the plant or cell thereof at least one recombinant polynucleotide encoding an IPD090 polypeptide or chimeric IPD090 polypeptide. In some embodiments methods are provided for protecting a plant from an insect pest, comprising expressing in the plant or cell thereof a recombinant polynucleotide encoding IPD090 polypeptide of SEQ ID NO: 2, SEQ ID NO: 4, SEQ ID NO: 6, SEQ ID NO: 379, SEQ ID NO: 384 or variants thereof.

In some embodiments methods are provided for protecting a plant from an insect pest, comprising expressing in the plant or cell thereof a recombinant polynucleotide encoding the polypeptide of SEQ ID NO: 385, SEQ ID NO: 386, SEQ ID NO: 387, SEQ ID NO: 388 or variants thereof. In some embodiments methods are provided for protecting a plant from an insect pest, comprising expressing in the plant or cell thereof the recombinant polynucleotide of SEQ ID NO: 381, SEQ ID NO: 382 or SEQ ID NO: 383.

Insect Resistance Management (IRM) Strategies Expression of *B. thuringiensis* δ-endotoxins in transgenic corn plants has proven to be an effective means of controlling agriculturally important insect pests (Perlak, et al., 1990; 1993). However, insects have evolved that are resistant to *B. thuringiensis* δ-endotoxins expressed in transgenic plants. Such resistance, should it become widespread, would clearly limit the commercial value of germplasm containing genes encoding such *B. thuringiensis* δ-endotoxins.

One way to increasing the effectiveness of the transgenic insecticides against target pests and contemporaneously reducing the development of insecticide-resistant pests is to use provide non-transgenic (i.e., non-insecticidal protein) refuges (a section of non-insecticidal crops/corn) for use with transgenic crops producing a single insecticidal protein active against target pests. The United States Environmental Protection Agency (epa.gov/oppbppdl/biopesticides/pips/bt_corn_refuge_2006.htm, which can be accessed using the www prefix) publishes the requirements for use with transgenic crops producing a single Bt protein active against target pests. In addition, the National Corn Growers Association, on their website: (ncga.com/insect-resistance-management-fact-sheet-bt-corn, which can be accessed using the www prefix) also provides similar guidance regarding refuge requirements. Due to losses to insects within the refuge area, larger refuges may reduce overall yield.

Another way of increasing the effectiveness of the transgenic insecticides against target pests and contemporaneously reducing the development of insecticide-resistant pests would be to have a repository of insecticidal genes that are effective against groups of insect pests and which manifest their effects through different modes of action.

Expression in a plant of two or more insecticidal compositions toxic to the same insect species, each insecticide being expressed at efficacious levels would be another way to achieve control of the development of resistance. This is based on the principle that evolution of resistance against two separate modes of action is far more unlikely than only one. Roush, for example, outlines two-toxin strategies, also called "pyramiding" or "stacking," for management of insecticidal transgenic crops. (The Royal Society. Phil. Trans. R. Soc. Lond. B. (1998) 353:1777-1786). Stacking or pyramiding of two different proteins each effective against the target pests and with little or no cross-resistance can allow for use of a smaller refuge. The US Environmental Protection Agency requires significantly less (generally 5%) structured refuge of non-Bt corn be planted than for single trait products (generally 20%). There are various ways of providing the IRM effects of a refuge, including various geometric planting patterns in the fields and in-bag seed mixtures, as discussed further by Roush.

In some embodiments the IPD090 polypeptides of the disclosure are useful as an insect resistance management strategy in combination (i.e., pyramided) with other pesticidal proteins include but are not limited to Bt toxins, *Xenorhabdus* sp. or *Photorhabdus* sp. insecticidal proteins, other insecticidally active proteins, and the like.

Provided are methods of controlling Lepidoptera and/or Coleoptera insect infestation(s) in a transgenic plant that promote insect resistance management, comprising expressing in the plant at least two different insecticidal proteins having different modes of action.

In some embodiments the methods of controlling Lepidoptera and/or Coleoptera insect infestation in a transgenic plant and promoting insect resistance management comprises the presentation of at least one of the IPD090 polypeptide insecticidal proteins to insects in the order *Lepidoptera* and/or Coleoptera.

In some embodiments the methods of controlling Lepidoptera and/or Coleoptera insect infestation in a transgenic plant and promoting insect resistance management comprises the presentation of at least one of the IPD090 polypeptides of SEQ ID NO: 2, SEQ ID NO: 4, SEQ ID NO: 6, SEQ ID NO: 379, SEQ ID NO: 384 or variants thereof, insecticidal to insects in the order *Lepidoptera* and/or Coleoptera.

In some embodiments the methods of controlling Lepidoptera and/or Coleoptera insect infestation in a transgenic plant and promoting insect resistance management comprise expressing in the transgenic plant an IPD090 polypeptide and a Cry protein or other insecticidal protein to insects in the order Lepidoptera and/or Coleoptera having different modes of action.

In some embodiments the methods, of controlling Lepidoptera and/or Coleoptera insect infestation in a transgenic plant and promoting insect resistance management, comprise expression in the transgenic plant an IPD090 polypeptide of SEQ ID NO: 2, SEQ ID NO: 4, SEQ ID NO: 6, SEQ ID NO: 379, SEQ ID NO: 384 or variants thereof and a Cry protein or other insecticidal protein to insects in the order *Lepidoptera* and/or Coleoptera, where the IPD090 polypeptide and Cry protein have different modes of action.

Also provided are methods of reducing likelihood of emergence of *Lepidoptera* and/or Coleoptera insect resistance to transgenic plants expressing in the plants insecticidal proteins to control the insect species, comprising expression of an IPD090 polypeptide insecticidal to the insect species in combination with a second insecticidal protein to the insect species having different modes of action.

Also provided are means for effective Lepidoptera and/or Coleoptera insect resistance management of transgenic plants, comprising co-expressing at high levels in the plants two or more insecticidal proteins toxic to Lepidoptera and/or Coleoptera insects but each exhibiting a different mode of effectuating its killing activity, wherein the two or more insecticidal proteins comprise an IPD090 polypeptide and a Cry protein. Also provided are means for effective Lepidoptera and/or Coleoptera insect resistance management of transgenic plants, comprising co-expressing at high levels in the plants two or more insecticidal proteins toxic to *Lepidoptera* and/or Coleoptera insects but each exhibiting a different mode of effectuating its killing activity, wherein the two or more insecticidal proteins comprise an IPD090 polypeptide of SEQ ID NO: 2, SEQ ID NO: 4, SEQ ID NO: 6, SEQ ID NO: 379, SEQ ID NO: 384 or variants thereof and a Cry protein or other insecticidally active protein.

In addition, methods are provided for obtaining regulatory approval for planting or commercialization of plants expressing proteins insecticidal to insects in the order *Lepidoptera* and/or Coleoptera, comprising the step of referring to, submitting or relying on insect assay binding data showing that the IPD090 polypeptide does not compete with binding sites for Cry proteins in such insects. In addition, methods are provided for obtaining regulatory approval for planting or commercialization of plants expressing proteins insecticidal to insects in the order *Lepidoptera* and/or Coleoptera, comprising the step of referring to, submitting or relying on insect assay binding data showing that the IPD090 polypeptide of SEQ ID NO: 2, SEQ ID NO: 4, SEQ ID NO: 6, SEQ ID NO: 379, SEQ ID NO: 384 or variant thereof does not compete with binding sites for Cry proteins in such insects.

Methods for Increasing Plant Yield

Methods for increasing plant yield are provided. The methods comprise providing a plant or plant cell expressing a polynucleotide encoding the pesticidal polypeptide sequence disclosed herein and growing the plant or a seed thereof in a field infested with a pest against which the polypeptide has pesticidal activity. In some embodiments, the polypeptide has pesticidal activity against a Lepidopteran, Coleopteran, Dipteran, Hemipteran or nematode pest, and the field is infested with a Lepidopteran, Hemipteran, Coleopteran, Dipteran or nematode pest.

As defined herein, the "yield" of the plant refers to the quality and/or quantity of biomass produced by the plant. "Biomass" as used herein refers to any measured plant product. An increase in biomass production is any improvement in the yield of the measured plant product. Increasing plant yield has several commercial applications. For example, increasing plant leaf biomass may increase the yield of leafy vegetables for human or animal consumption. Additionally, increasing leaf biomass can be used to increase production of plant-derived pharmaceutical or industrial products. An increase in yield can comprise any statistically significant increase including, but not limited to, at least a 1% increase, at least a 3% increase, at least a 5% increase, at least a 10% increase, at least a 20% increase, at least a 30%, at least a 50%, at least a 70%, at least a 100% or a greater increase in yield compared to a plant not expressing the pesticidal sequence.

In specific methods, plant yield is increased as a result of improved pest resistance of a plant expressing an IPD090 polypeptide disclosed herein. Expression of the IPD090 polypeptide results in a reduced ability of a pest to infest or feed on the plant, thus improving plant yield.

Methods of Processing

Further provided are methods of processing a plant, plant part or seed to obtain a food or feed product from a plant, plant part or seed comprising an IPD090 polynucleotide. The plants, plant parts or seeds provided herein, can be processed to yield oil, protein products and/or by-products that are derivatives obtained by processing that have commercial value. Non-limiting examples include transgenic seeds comprising a nucleic acid molecule encoding an IPD090 polypeptide which can be processed to yield soy oil, soy products and/or soy by-products.

"Processing" refers to any physical and chemical methods used to obtain any soy product and includes, but is not limited to, heat conditioning, flaking and grinding, extrusion, solvent extraction or aqueous soaking and extraction of whole or partial seeds The following examples are offered by way of illustration and not by way of limitation.

EXPERIMENTALS

Example 1—Identification of an Insecticidal Protein Active Against Western Corn Rootworm (*Diabrotica virqifera virgifera* LeConte—WCRW) from Strain JH34071-1

The insecticidal protein designated as IPD090Aa was identified by protein purification, N-terminal amino acid sequencing, and PCR cloning from *Pseudomonas* sp. strain JH34071-1 as follows. Insecticidal activity against WCRW was observed from a cell lysate of JH34071-1 that was grown in Tryptic Soy broth (TSB, peptone from casein 15 g/L; peptone from soymeal 5.0 g/L; NaCl 5.0 g/L) and cultured 1 day at 28° C. with shaking at 200 rpm. This insecticidal activity exhibited heat and protease sensitivity indicating a proteinaceous nature.

Bioassays with WCRW were conducted using the cell lysate samples mixed with *Diabrotica* diet (Frontier Agricultural Sciences, Newark, Del.) in a 96 well format. WCRW neonates were placed into each well of a 96 well plate. The assay was run four days at 25° C. and then was scored for insect mortality and stunting of insect growth. The scores were noted as dead (3), severely stunted (2) (little or no growth but alive), stunted (1) (growth to second instar but not equivalent to controls) or no activity (0). Samples demonstrating mortality or severe stunting were further studied.

Genomic DNA of isolated strain JH34071-1 was prepared according to a library construction protocol developed by Illumina and sequenced using the Illumina® Genome Analyzer IIx (Illumina Inc., 9885 Towne Center Drive, San Diego, Calif. 92121). The nucleic acid contig sequences were assembled and open reading frames were generated. The 16S ribosomal DNA sequence of strain JH34071-1 was BLAST™ searched against the NCBI database identifying strain JH34071-1 as a *Pseudomonas* species.

Cell pellets of strain JH34071-1 were homogenized at 30,000 psi after re-suspension in 20 mM Tris buffer, pH 8 with "Complete, EDTA-free" protease inhibitor cocktail (Roche, Indianapolis, Ind.). The crude lysate was cleared by centrifugation and brought to 75% saturation with ammonium sulfate. The 75% ammonium sulfate solution was then centrifuged and the supernatant was discarded. The pellet portion was suspended in 20 mM Tris pH 8.0 and then brought to 1.5 M ammonium sulfate with the addition of a 2 M ammonium sulfate, 20 mM Tris pH 8.0 solution. This solution was clarified and loaded onto a TSKgel™ Phenyl-5PW column (Tosoh Bioscience, Tokyo, Japan) equilibrated in 20 mM Tris pH 8.0, 1.5 M ammonium sulfate. Insecticidal activity eluted with a gradient to 20 mM Tris, pH 8. Active fractions were pooled, concentrated on 10 kDa molecular weight cutoff centrifugal concentrators (Sartorius Stedim, Goettingen, Germany) and desalted into 20 mM piperazine pH 9.5 using a Sephadex G25 (GE Healthcare, Piscataway, N.J.) column. The desalted pool was loaded onto a Mono Q™ column (GE Healthcare, Piscataway, N.J.) equilibrated in 20 mM piperazine, pH 9.5 and eluted with a gradient of 0 to 0.4 M NaCl. Active fractions were pooled and loaded onto a Superdex™ 200 column (GE Healthcare) equilibrated in phosphate buffered saline (PBS). SDS-PAGE analysis of fractions indicated that WCRW activity coincided with a prominent band after staining with GelCode™ Blue Stain Reagent (Thermo Fisher Scientific®). The protein band was excised, digested with trypsin and analyzed by nano-liquid chromatography/electrospray tandem mass spectrometry (nano-LC/ESI-MS/MS) on a Thermo Q Exactive™ Orbitrap™ mass spectrometer (Thermo Fisher Scientific®, 81 Wyman Street, Waltham, Mass. 02454) interfaced with an Eksigent™ NanoLC™ 1-D Plus nano-Ic system (AB Sciex™, 500 Old Connecticut Path, Framingham, Mass. 01701). Protein identification was done by internal database searches using Mascot® (Matrix Science, 10 Perrins Lane, London NW3 1QY UK), which identified the IPD090Aa polypeptide (SEQ ID NO: 2) encoded by the polynucleotide of SEQ ID NO: 1. Cloning and recombinant expression confirmed the insecticidal activity of the IPD090Aa polypeptide (SEQ ID NO: 2) against WCRW.

Example 2—Identification of Homologs of IPD090Aa

Gene identities may be determined by conducting BLAST™ (Basic Local Alignment 20 Search Tool; Altschul, et al. (1993) *J. Molec. Biol.* 215: 403-410; see also ncbi.nlm-.nih.gov/BLAST/, which can be accessed using the www prefix) searches under default parameters for similarity to sequences contained in the publically available BLAST database (comprising all non-redundant GenBank CDS translations, sequences derived from the 3-Dimensional Brookhaven Data Bank, and DDBJ databases. In addition to public databases DuPont Pioneer databases were searched. IPD090Aa (SEQ ID NO: 2) showed distant homology to proteins which have a Pfam ID #PF01823 which have membrane attack complex/perforin (MACPF) domains (Reference to Pfam database: en.wikipedia.org/wiki/Pfam, which can be accessed using the www prefix). Several homologs of the IPD090Aa polypeptide (SEQ ID NO: 2) identified having varying percent identity are shown in Table 1. Table 2 shows a matrix table of pair-wise identity relationships for global alignments of the IPD090 homologs, based upon the ClustalW algorithm implemented using the in the ALIGNX® module of the Vector NTI® Program Suite (Invitrogen Corporation, Carlsbad, Calif.) with all default parameters.

TABLE 1

| Protein identifier | Identity to IPD090Aa | Strain identifier | Species | Polynucleotide | Polypeptide |
|---|---|---|---|---|---|
| IPD090Aa | | JH34071-1, SSP342A9-1 | Pseudomonas sp. | SEQ ID NO: 1 | SEQ ID NO: 2 |
| IPD090Ab | 99.8% | SS342A7-1 | Pseudomonas monteilii | SEQ ID NO: 3 | SEQ ID NO: 4 |
| IPD090Ca | 79.3% | JH23589-1, JH23611-2, JH23959-1, JH59556-2, JH61488-2, JH62159-2, JH62167-1, JH62246-2, JH62258-1, JH62270-2, and JH62417-2 | Pseudomonas entomophila | SEQ ID NO: 5 | SEQ ID NO: 6 |
| IPD090Fa | 49.4% | GenBank Accession # WP_019961352 | Woodsholea maritima | SEQ ID NO: 7 | SEQ ID NO: 8 |
| IPD090Ac | 89.1% | SSP1049E7- | Pseudomonas monteilii | SEQ ID NO: 380 | SEQ ID NO: 384 |
| IPD090Ga | 38.9 | GenBank Accession # WP_012039071 | Clavibacter michiganensis | SEQ ID NO: 381 | SEQ ID NO: 385 |
| IPD090Gb | 35.6 | GenBank Accession # WP_012145116 | Serratia proteamaculans | SEQ ID NO: 382 | SEQ ID NO: 386 |
| IPD090Gc | 37.9 | GenBank Accession # WP_046018755.1 | Marinomonas sp. | SEQ ID NO: 383 | SEQ ID NO: 387 |
| IPD090Gd | 36.2 | GenBank Accession # WP_073439185 | Serratia plymuthica | | SEQ ID NO: 388 |

TABLE 2

| | IPD090Ab SEQ ID NO: 4 | IPD090Ac SEQ ID NO: | IPD090Ca SEQ ID NO: 6 | IPD090Cd SEQ ID NO: 379 | IPD090Fa SEQ ID NO: 8 | IPD090Ga SEQ ID NO: 385 | IPD090Gb SEQ ID NO: 386 | IPD090Gc SEQ ID NO: 387 | IPD090Gd SEQ ID NO: 388 |
|---|---|---|---|---|---|---|---|---|---|
| IPD090Aa SEQ ID NO: 2 | 99.8 | 89.1 | 79.3 | 79.8 | 50.8 | 38.9 | 35.6 | 37.9 | 36.2 |
| IPD090Ab SEQ ID NO: 4 | — | 88.9 | 79.1 | 79.5 | 50.8 | 38.7 | 35.4 | 37.7 | 36.0 |
| IPD090Ac SEQ ID NO: 384 | — | — | 76.8 | 77.6 | 48.9 | 36.8 | 35.1 | 36.6 | 35.4 |
| IPD090Ca SEQ ID NO: 6 | — | — | — | 80.3 | 48.5 | 36.2 | 35.5 | 36.9 | 36.9 |
| IPD090Cd SEQ ID NO: 379 | — | — | — | — | 47.2 | 37.7 | 36.3 | 37.7 | 38.7 |
| IPD090Fa SEQ ID NO: 8 | — | — | — | — | — | 34.5 | 34.3 | 39.4 | 35.3 |
| IPD090Ga SEQ ID NO: 385 | — | — | — | — | — | — | 34.3 | 32.7 | 33.5 |
| IPD090Gb SEQ ID NO: 386 | — | — | — | — | — | — | — | 33.5 | 82.8 |
| IPD090Gc SEQ ID NO: 387 | — | — | — | — | — | — | — | — | 32.9 |

Genome sequencing of a pool of bacterial strains identified the polynucleotide of SEQ ID NO: 378 encoding the IPD090 homolog, IPD090Cd (SEQ ID NO: 379) having ~80% amino acid sequence identity to IPD090Ca (SEQ ID NO: 6).

Example 3—E. coli Expression of IPD090Aa

Peptide fragments from MS analysis were used to locate the IPD090Aa coding sequence (SEQ ID NO: 1) within the JH34071-1 contig. Additionally, N-terminal sequencing was used to confirm the predicted start site. The coding sequence was used to design the primers CTB54-FOR (SEQ ID NO: 354) and CTB55-REV (SEQ ID NO: 355) to clone the IPD090Aa coding sequence (SEQ ID NO: 1) (with the native stop codon TAG) into pET-24a (Novagen®) for untagged translation and pET-14b (Novagen®) for an N-terminal translation of a 6×-His tag using NdeI/XhoI sites. Additionally, the coding sequence was used to design the primers CTB54-FOR (SEQ ID NO: 354) and CTB56-REV (SEQ ID NO: 356) to clone the IPD090Aa coding sequence (SEQ ID NO: 1) (with no stop codon) into pET-24a (Novagen®) for a C-terminal translation of a 6×-His tag using NdeI/XhoI sites. The KOD Hot Start Master Mix (EMD Biosciences, San Diego, Calif.) was used for PCR amplification of the IPD090Aa gene on a Bio-Rad™ C1000 Touch™ thermal cycler. Cycling parameters are as follows: 1 cycle at 95° C. for 2 minutes; 35 cycles of 95° C. for 20 seconds, 60° C. for 10 seconds and 70° C. for 15 seconds; 1 cycle at 70° C. for 2 minutes. Amplicons were gel purified, ligated (T4 DNA Ligase, New England BioLabs, Ipswich, Mass.) into expression vectors (as described above), transformed into E. coli One Shot® TOP10 high efficiency chemically competent cells (Invitrogen™-Thermo Fisher Scientific, 81 Wyman Street, Waltham, Mass.) and clones were confirmed by sequencing.

The IPD090Aa N-terminal 6× His (SEQ ID NO: 346) and IPD090Aa C-terminal 6×-His (SEQ ID NO: 348) expressing constructs were transformed into E. coli BL21 (DE3, Agilent, Santa Clara Calif.) expression cells. One Liter Luria Broth cultures (containing the appropriate antibiotic) were grown until an $OD_{600}$ of approximately 0.6 was reached and then the cultures were induced with 0.3 mM isopropyl-β-D-1-thiogalactopyranoside (IPTG) and allowed to grow for an additional 18 hours at 16° C., 100 rpm. The cultures were centrifuged at 5,000 rcf for 15 minutes to pellet the cells. Cell pellets were lysed with ¼ B-PER™ II reagent (Thermo Scientific), 20 mM Tris pH 8.0, OmniCleave™ endonuclease (Epicentre), ReadyLyse™ lysozyme (Epicentre) and HALT™ Protease Inhibitors (Life Technologies) for 30 minutes rocking at room temperature. The lysates were cleared via centrifugation at 13,000 rcf for 10 minutes and the supernatants were brought up to 10 mM Imidazole and then applied to separate 2.5 mL Ni-NTA (QIAGEN® Inc., Valencia, Calif. 91355) columns equilibrated with PBS, 10 mM imidazole. Columns were washed with 5 mL of 20, 40 and 80 mM Imidazole in PBS. Recombinantly expressed IPD090Aa N-terminal 6x-His polypeptide (SEQ ID NO: 347) and IPD090Aa C-terminal 6x-His polypeptide (SEQ ID NO: 349) were eluted off the columns with 2.5 mL of 150 mM imidazole in PBS. Both 2.5 mL eluents were applied to separate PD10 (GE Healthcare) desalting columns and proteins were eluted off with 3.5 mL PBS. Purified and desalted IPD090Aa N-terminal polypeptide (SEQ ID NO: 347) and IPD090Aa C-terminal 6x-His tagged polypeptide (SEQ ID NO: 349) were submitted to bioassay against WCRW and were active (Table 3). Additionally, IPD090Aa polypeptide (SEQ ID NO: 2) clear lysate from a 50 mL induction was FPLC-purified and submitted to bioassay against WCRW and was active (see Example 4 below).

Example 4—Purification of Recombinant IPD090Aa Polypeptide

A cell pellet from a 1 L *E. coli* culture expressing IPD090Aa polypeptide (SEQ ID NO: 2) was suspended in 100 mL 20 mM Tris pH 8.0+1:100 HALT™ proteinase inhibitor cocktail (Life Technologies). Cells were lysed at 30,000 PSI and the lysate centrifuged at 30,000 g for 30 min. To the supernatant ammonium sulfate was added to a final concentration of 1.5 M and the solution allowed to equilibrate overnight. After clarification the supernatant was loaded onto a phenyl-5PW column (GE Healthcare, Piscataway, N.J.) equilibrated in 1.5 M ammonium sulfate, 20 mM Tris, pH 8.0. The column was washed with 4 column volumes (CV), and IPD090Aa polypeptide (SEQ ID NO: 2) containing fractions eluted with a 10 CV gradient to 20 mM Tris, pH 8.0. Eluate with IPD090Aa polypeptide (SEQ ID NO: 2) was concentrated and further purified by size exclusion chromatography on an S200 column (GE Healthcare, Piscataway, N.J.) equilibrated in PBS. Based on SDS-PAGE, fractions with purified IPD090Aa polypeptide (SEQ ID NO: 2) were combined.

Example 5—Coleoptera Assays with Purified IPD090Aa Protein

Insecticidal activity bioassay screens were conducted with purified recombinant IPD090Aa polypeptide (SEQ ID NO: 2) as well as N-terminally His-tagged IPD090Aa polypeptide (SEQ ID NO: 347) and C-terminally His-tagged IPD090Aa polypeptide (SEQ ID NO. 349) to evaluate the insecticidal protein effects on larvae of a variety of Coleoptera including Western corn rootworm (*Diabrotica virgifera*)—WCRW and Northern corn rootworm (*Diabrotica barberi*)—NCRW, Coleoptera feeding assays were conducted on an artificial diet containing the insecticidal protein. The insecticidal proteins were incorporated into a Coleopteran-specific artificial diet (Frontier Agricultural Sciences, Newark, Del.). The proteins were assayed in a dilution series from 188 ppm to 6 ppm. One neonate larva was placed in each well to feed ad libitum for 4 days. Each bioassay was done with eight replicates at each dose. Results were expressed as positive for larvae reactions such as stunting and or mortality. Results were expressed as negative if the larvae were similar to the negative control that was fed a diet to which the above buffer only was applied. The average WCRW score for the dilution series from 8 assay replicates for the IPD090Aa polypeptide (SEQ ID NO: 2), the IPD090Aa N-terminal 6x His polypeptide (SEQ ID NO: 347), and IPD090Aa C-terminal 6x-His polypeptide (SEQ ID NO: 349) are shown in Table 3.

TABLE 3

| Purified Polypeptide | Polypeptide Concentration (ppm) | Avg. WCRW Score | Purified Polypeptide | Polypeptide Conc. (ppm) | Avg. WCRW Score | Purified Polypeptide | Polypeptide Conc. (ppm) | Avg. WCRW Score |
|---|---|---|---|---|---|---|---|---|
| IPD090Aa SEQ ID NO: 2 | 188 | 2.4 | IPD090Aa-N-term 6X His SEQ ID NO: 347 | 188 | 2.5 | IPD090Aa-C-term 6x His SEQ ID NO: 349 | 188 | 2.0 |
|  | 131 | 2.0 |  | 131 | 2.0 |  | 131 | 2.0 |
|  | 94 | 2.0 |  | 94 | 2.3 |  | 94 | 1.8 |
|  | 66 | 2.0 |  | 66 | 2.0 |  | 66 | 1.8 |
|  | 47 | 2.0 |  | 47 | 2.0 |  | 47 | 1.3 |
|  | 33 | 1.8 |  | 33 | 1.8 |  | 33 | 1.4 |
|  | 23 | 1.4 |  | 23 | 2.0 |  | 23 | 1.5 |
|  | 16 | 1.3 |  | 16 | 1.0 |  | 16 | 1.0 |
|  | 12 | 0.3 |  | 12 | 1.1 |  | 12 | 0.4 |
|  | 8 | 0 |  | 8 | 0.5 |  | 8 | 0.3 |
|  | 6 | 0 |  | 6 | 0.1 |  | 6 | 0.0 |
| PBS Buffer Control | 0 | 0 | PBS Buffer Control | 0 | 0 | PBS Buffer Control | 0 | 0 |

Example 6—*E. coli* Expression and Insecticidal Activity of an N-Terminally Truncated IPD090Aa Polypeptide WCRW Bioassays with trypsinized IPD090Aa polypeptide (SEQ ID NO: 2) indicated that a truncated IPD090Aa product was insecticidal. N-terminal sequencing of trypsinized IPD090Aa polypeptide fragment demonstrated that a polypeptide product starting at alanine 25 of SEQ ID NO: 2 was formed. A polynucleotide (SEQ ID NO: 9) encoding the IPD090Aa (TR1) polypeptide (SEQ ID NO: 10) was generated by amplifying the IPD090Aa gene (SEQ ID NO: 1) using the primers CTB142-FOR (SEQ ID NO: 357) and CTB55-REV (SEQ ID NO: 355) to clone the IPD090Aa (TR1) coding sequence (with the native stop codon TAG) into pET-24a (Novagen) for untagged translation. The KOD Hot Start Master Mix (EMD Biosciences, San Diego, Calif.) was used for PCR amplification of the IPD090Aa (TR1) gene on a Bio-Rad® C1000 Touch™ thermal cycler. Cycling parameters are as follows: 1 cycle at 95° C. for 2 minutes; 35 cycles of 95° C. for 20 seconds, 60° C. for 10 seconds and 70° C. for 15 seconds; 1 cycle at 70° C. for 2 minutes. Amplicons were gel purified, ligated (T4 DNA Ligase, New England BioLabs, Ipswich, Mass.) into expression vectors (as described above), transformed into *E. coli* One Shot® TOP10 high efficiency chemically competent cells (Invitrogen) and clones were confirmed by sequencing.

Confirmed clones expressing the IPD090Aa (TR1) polypeptide (SEQ ID NO: 10) were transformed into BL21-Gold expression cells for 1 L inductions. Induction pellets were lysed in 30 mL lysis buffer (20 mM Tris pH 8, ¼×B-PER™ II, Omni-Cleave™, Ready-Lyse™ and HALT™ (Life Technologies)) rocking at room temp for 1 hour. The lysate was centrifuged at 30,000 g for 30 min. To the supernatant ammonium sulfate was added to a final concentration of 1.5 M and the solution allowed to equilibrate overnight. After clarification the supernatant was loaded onto a phenyl-5PW column (GE Healthcare, Piscataway, N.J.) equilibrated in 1.5 M ammonium sulfate, 20 mM Tris, pH 8.0. The column was washed with 4 column volumes (CV), and IPD090Aa (TR1) polypeptide (SEQ ID NO: 10) containing fractions eluted with a 10 column volume gradient to 20 mM Tris, pH 8.0. Eluate fractions containing IPD090Aa (TR1) polypeptide (SEQ ID NO: 10) were concentrated and desalted into PBS buffer using a Sephadex™ G-25 (GE Healthcare) column and was submitted to bioassay against WCRW. The average WCRW scores for the IPD090Aa (TR1) polypeptide (SEQ ID NO: 10) dilution series from 8 assay replicates are shown in Table 4.

TABLE 4

| Purified Polypeptide | Polypeptide Concentration (mg/ml) | Avg. WCRW Score |
|---|---|---|
| IPD090Aa(TR1) SEQ ID NO: 10 | 2.667 | 2.8 |
| | 1.43 | 2.3 |
| | 0.655 | 2.0 |
| | 0.298 | 1.5 |
| | 0.14 | 0.4 |
| | 0.069 | 0 |
| | 0.035 | 0 |
| | 0.024 | 0 |
| PBS buffer control | 0 | 0 |

Example 7—*E. coli* Expression of IPD090Ca Polypeptide

The sequence encoding the IPD090Ca polypeptide (SEQ ID NO: 6) was isolated from strain JH23959-1 using primers CTB60-FOR (SEQ ID NO: 358) and CTB63-REV (SEQ ID NO: 359) to amplify the gene from strain JH23959-1 and clone the IPD090Ca coding sequence (SEQ ID NO: 5) (with the native stop codon (TAA)) into pET-24a (Novagen) for translation and pET-14b (Novagen) for an N-terminal translation of a 6x-His tag using NdeI/BamHI sites. The KOD Hot Start Master Mix (EMD Biosciences, San Diego, Calif.) was used for PCR amplification of the IPD090Ca gene on a Bio-Rad™ C1000 Touch™ thermal cycler. Cycling parameters are as follows: 1 cycle at 95° C. for 2 minutes; 35 cycles of 95° C. for 20 seconds, 60° C. for 10 seconds and 70° C. for 15 seconds; 1 cycle at 70° C. for 2 minutes. Amplicons were gel purified, ligated (T4 DNA Ligase, New England BioLabs, Ipswich, Mass.) into expression vectors (as described above), transformed into *E. coli* One Shot® TOP10 high efficiency chemically competent cells (Invitrogen) and clones were confirmed by sequencing.

Confirmed clones expressing IPD090Ca (SEQ ID NO: 5) in pET-24a/BL21, 50 mL LB-CARB and KAN cultures were seeded with 500 µL of overnight culture and incubated 37° C., 200 rpm until a $OD_{600}$ ~0.8 was reached. Cultures were induced with 0.3 mM IPTG and incubated at 16° C., 100 rpm overnight (~20 hrs.). After induction, the cultures were centrifuged at 5,000 rcf for 15 minutes to pellet cells. The cell pellets were stored at −80° C. overnight prior to lysis. After freeze/thaw, the cell pellets were lysed with 3 mL of lysis buffer (20 mM Tris pH 8, ¼×B-PER™ II, Omni-Cleave™, Ready-Lyse™ and Halt™ Protease Inhibitors), rocking at room temperature for 1 hour. The cell lysates were cleared via centrifugation at 13,000 rcf for 10 minutes. 2.5 mL of each cleared lysate was applied to a PD10 desalting column (GE Healthcare, Piscataway, N.J.), equilibrated with PBS. IPD090Ca polypeptide (SEQ ID NO: 6) was eluted off the PD10 columns with 3.5 mL PBS and the lysate was submitted to bioassay against WCRW. The average WCRW score for the dilution series of IPD090Ca polypeptide (SEQ ID NO: 6) from 8 assay replicates are shown in Table 5.

TABLE 5

| Test Sample | Total Lysate Protein Conc. (mg/mL) | Avg. WCRW Score |
|---|---|---|
| IPD090Ca (SEQ ID NO: 6) | 3.000 | 2.5 |
| | 2.060 | 2.5 |
| | 1.242 | 2.9 |
| | 0.691 | 2.5 |
| | 0.332 | 2.1 |
| | 0.212 | 2.0 |
| | 0.042 | 1.4 |
| | 0.038 | 0 |
| PBS Buffer Control | 0 | 0 |

Example 8—*E. coli* Expression of IPD090Fa Polypeptide

The IPD090Fa amino acid sequence (SEQ ID NO: 8) was identified by BLAST™ search of the public non-redundant protein sequence database at NCBI (NCBI Reference Sequence: WP_019961352.1). The corresponding *E. coli* optimized coding sequence (SEQ ID NO: 7) was generated as two overlapping synthetic DNA fragments (IDT, Coralville Iowa), the ends of which contained 30 nucleotides of homology with pET-24a (Novagen) at the NdeI/XhoI sites. The IPD090Fa C-terminal 6x-His (SEQ ID NO: 350) expression vector was generated using NEBuilder™ (New England Biolabs, Ipswich Mass.). Positive clones were confirmed by DNA sequencing.

The IPD090Fa C-terminal 6x-His (SEQ ID NO: 350) expression construct was transformed into *E. coli* BL21 (DE3, Agilent, Santa Clara Calif.) expression cells. 250 ml Luria Broth cultures (containing kanamycin) were grown at 37° C. until an OD600 of approximately 0.6 was reached and then the cultures were induced with 1 mM isopropyl-β-D-1-thiogalactopyranoside (IPTG) and allowed to grow for an additional 18 hours at 16° C., 250 rpm. The cultures were centrifuged at 5,000 rcf for 15 minutes to pellet the cells. Cell pellets were lysed with ¼ B-PER™ II reagent (Thermo Scientific), 20 mM Tris pH 8.0, OmniCleave™ endonuclease (Epicentre), ReadyLyse™ lysozyme (Epicentre) and HALT™ Protease Inhibitor Cocktail V (Millipore) for 120 minutes rocking at 30° C. The lysates were cleared via centrifugation at 13,000 rcf for 10 minutes and the supernatants were brought up to 10 mM Imidazole and then applied to separate 1 mL Ni-NTA (QIAGEN® Inc., Valencia, Calif. 91355) columns equilibrated with Tris buffered saline (TBS), 10 mM imidazole. Columns were washed two times with 5 mL of 10 mM Imidazole in TBS. Recombinantly expressed IPD090Fa C-terminal 6×-His polypeptide (SEQ ID NO: 351) was eluted off the columns with 1.2 mL of 300 mM imidazole in TBS. The 1.2 mL eluate was applied to a Zeba Spin Desalting Column (Thermo) and buffer exchanged to TBS. Purified and desalted IPD090Fa C-Terminal 6×-His tagged polypeptide (SEQ ID NO: 351) was submitted to bioassay against WCRW and was active (Table 6).

A cell pellet from a 1 L *E. coli* culture expressing the IPD090Fa polypeptide (SEQ ID NO: 8) was suspended in 5× volume (volume to weight) 20 mM Tris pH 8.0+1:100 HALT™ proteinase inhibitor cocktail (Thermo). Cells were lysed at 25,000 PSI and the lysate centrifuged at 30,000 g for 30 min. To the supernatant an equal volume of 3 M ammonium sulfate was added dropwise while stirring to a final concentration of 1.5 M and the solution was allowed to stir for at least 30 minutes. After clarification the supernatant was loaded onto a Phenyl-5PW column (Tosoh Bioscience, King of Prussia, Pa.) equilibrated in 1.5 M ammonium sulfate, 20 mM Tris, pH 8.0. The column was washed with 4 column volumes (CV), and IPD090Fa polypeptide (SEQ ID NO: 8) containing fractions eluted with a 15 CV gradient to 20 mM Tris, pH 8.0. Eluate with IPD090Fa polypeptide (SEQ ID NO: 8) was loaded onto a Mono Q™ column (GE Healthcare, Piscataway, N.J.) equilibrated in 20 mM Tris pH 8.0 buffer and IPD090Fa containing fractions eluted with a 40 CV gradient to 0.5 M NaCl, 20 mM Tris pH 8.0, concentrated, and further purified by size exclusion chromatography on an Superdex™ 200 column (GE Healthcare, Piscataway, N.J.) equilibrated in PBS. Based on SDS-PAGE, fractions with purified IPD090Fa polypeptide (SEQ ID NO: 8) were combined.

Example 9—Diet-Based Bioassays with Corn Rootworm for Determination of LC50 and IC50

Standardized corn rootworm diet incorporation bioassays were utilized to test the activity of the IPD090Aa polypeptide (SEQ ID NO: 2) on WCRW. Corn rootworm diet was prepared according to manufacturer's guideline for *Diabrotica* diet (Frontier, Newark, Del.). The test involved six different IPD090Aa polypeptide (SEQ ID NO: 2) doses plus buffer control with 32 observations for each dose in each bioassay. Neonates were infested into 96-well plates containing a mixture of the IPD090Aa polypeptide (SEQ ID NO: 2) (5 µL/well) and diet (25 µL/well), each well with approximately 5 to 8 larvae (<24 h post hatch). After one day a single larva was transferred into each well of a second 96-well plate containing a mixture of the IPD090Aa polypeptide (SEQ ID NO: 2) (20 µL/well) and diet (100 µL/well) at the same concentration as the treatment to which the insect was exposed on the first day. The plates were incubated at 27° C., 65% RH in the dark for 6 days. The 50% lethal concentration for polypeptides in the bioassay was calculated using "Dose Response Add-In for Excel" based on Probit analysis. Mortality and severe stunted counts were scored and pooled as total response for the calculation of inhibition of 50% of the individuals using the same method. The LC50 and IC50 against WCRW (*Diabrotica virgifera virgifera*) were 16.3 ppm and 7.4 ppm, respectively and against NCRW (*Diabrotica barberi*) were 35.6 ppm and 13 ppm, respectively. Against *Diabrotica speciosa* the LC50 was >400 ppm and IC50=320 ppm. The same assay protocol was used to evaluate the toxicity of IPD090Aa C-terminal 6×-His polypeptide (SEQ ID NO: 349) and IPD090Fa C-terminal 6×-His polypeptide (SEQ ID NO: 351) against WCRW and NCRW. The results are shown in Table 6.

TABLE 6

| Insect | Sample | LC/IC | ppm | Lower 95% CL | Upper 95% CL | Slope | N |
|---|---|---|---|---|---|---|---|
| WCRW | IPD090Aa C-term-6xHis (SEQ ID NO: 349) | LC50 | 42.0 | 31.8 | 63.9 | 2.1 | 128.0 |
|  |  | IC50 | 17.6 | 14.2 | 21.9 | 2.6 | 158.0 |
|  | IPD090Fa C-term-6xHis (SEQ ID NO: 351) | LC50 | 9.0 | 7.0 | 11.3 | 2.4 | 186.0 |
|  |  | IC50 | 5.7 | 4.4 | 7.0 | 2.7 | 154.0 |
| NCRW | IPD090Aa C-term-6xHis (SEQ ID NO: 349) | LC50 | 100.2 | 69.7 | 122.6 | 7.9 | 47.0 |
|  |  | IC50 | 54.4 | 36.4 | 81.7 | 2.6 | 79.0 |
|  | IPD090Fa C-term-6xHis (SEQ ID NO: 351) | LC50 | 13.9 | 10.5 | 18.2 | 3.4 | 79.0 |
|  |  | IC50 | 9.2 | 6.5 | 12.0 | 4.0 | 63.0 |

Example 10—Testing Cross-Resistance of mCry3A-Selected WCRW

LC50 was also determined for IPD090Aa polypeptide (SEQ ID NO: 2) against WCRW resistant to mCry3A and compared to susceptible WCRW using the same method as diet-based bioassays on WCRW as described in Example 8 above. A WCRW strain resistant to mCry3A was developed by selections on transgenic maize plants with high level of mCry3A expression (>10,000 ng/mg of total soluble protein in T0 roots) and high efficacy on WCRW. The resistance ratio (RR) was >92-fold to mCry3A for the colony based on LC50 in a diet-based assay (Patent Publication No. US 20140033361). The RR was calculated as follows: RR=(LC50 of resistant WCRW)/(LC50 of susceptible WCRW). Table 7 shows that the WCRW strain resistant to mCry3A was not cross-resistant (RR=1.4-fold) to IPD090Aa polypeptide (SEQ ID NO: 2).

TABLE 7

| WCRW colony | n | IPD090Aa (SEQ ID NO: 2), (µg/mL) | 95% CL | Slope (SE) | Resistance Ratio (RR) |
|---|---|---|---|---|---|
| Control | 230 | 25.4 | 19.3-34.5 | 1.8 (0.3) | 1.0 |
| mCry3A-res* | 240 | 35.3 | 26.5-46.5 | 2.3 (0.4) | 1.4 |

Example 11—Chimeras Between IPD090 Homologs

To generate active variants of IPD090Aa polypeptide (SEQ ID NO: 2) with diversified sequences, chimera genes between IPD090Aa (SEQ ID NO: 1) and IPD090Ca (SEQ ID NO: 5) were generated by multi-PCR fragment overlap assembly. For this purpose the nucleotide sequence of IPD090Ca was codon harmonized to that of IPD090Aa making the DNA homology higher to allow for the family shuffling and chimera construction. The codon modified IPD090Ca coding sequence has the nucleic acid sequence of SEQ ID NO: 345. A total of seven IPD090Aa/IPD090Ca chimera polynucleotides were constructed and cloned into pET24a. Constructs were transformed into BL21 DE3 and cultured in 48-well plates for protein expression. Cell lysates were generated by B-PER® Protein Extraction Reagent from Thermo Scientific (3747 N. Meridian Rd., Rockford, Ill. USA 61101) and screened for WCRW insecticidal activity. Table 8 shows the chimera protein boundaries and the % sequence identity to IPD090Aa polypeptide (SEQ ID NO: 2).

TABLE 8

| Chimera Designation | polynucleotide | IPD090Aa (SEQ ID NO: 2) N-term fragment | IPD090Ca (SEQ ID NO: 6) C-term fragment | % Seq. identity to IPD090Aa | WCRW active |
|---|---|---|---|---|---|
| Chimera 1 SEQ ID NO: 12 | SEQ ID NO: 11 | M1-A239 | R241-K483 | 88.6 | Yes |
| Chimera 2 SEQ ID NO: 14 | SEQ ID NO: 13 | M1-V296 | P297-K483 | 90.9 | Yes |
| Chimera 3 SEQ ID NO: 16 | SEQ ID NO: 15 | M1-G348 | D349-K483 | 93.8 | Yes |
| Chimera 4 SEQ ID NO: 18 | SEQ ID NO: 17 | M1-Q382 | A383-K483 | 94.8 | Yes |
| Chimera 5 SEQ ID NO: 20 | SEQ ID NO: 19 | M1-G422 | A423-K483 | 97.7 | Yes |
| Chimera 6 SEQ ID NO: 22 | SEQ ID NO: 21 | M1-K442 | I443-K483 | 98.8 | Yes |
| Chimera 7 SEQ ID NO: 24 | SEQ ID NO: 23 | M1-Q144 | S146-K483 | 86.5 | Yes |

Example 12—IPD090Aa Variants with Multiple Amino Acid Substitutions

To create variants of IPD090Aa polypeptide (SEQ ID NO: 2) with multiple amino acid changes, variant libraries were generated by family shuffling (Chia-Chun J. Chang et al, 1999, *Nature Biotechnology* 17, 793-797) polynucleotides encoding IPD090Aa (SEQ ID NO: 2), and IPD090Ca (SEQ ID NO: 6).

Three libraries were constructed for generating IPD090Aa variants. In the first library, the polynucleotide sequences of SEQ ID NO: 1 and SEQ ID NO: 5 were used as library parents. In the second library, the polynucleotide sequences of SEQ ID NO: 1 and SEQ ID NO: 5 were amplified in seven fragments with overlapping homology. Primers used to amplify the fragments are summarized in Table 9. The overlapping fragments were pooled and assembled.

TABLE 9

| Primer | Sequence |
|---|---|
| 90Aa Frag1 Forward | GAA GGA GAT ATA CAT ATG GAA MAC RTA GAC TTG CCA CAR GGA CTT GTA AAC TTT TCC (SEQ ID NO: 360) |
| 90Ca Frag1 Forward | GAA GGA GAT ATA CAT ATG GAA MAC RTC GAC CTG CCG ACR GGA CTC GTC AAA TTT TCC (SEQ ID NO: 361) |
| 90-2 Forward | TC GTR CCS GAG ATC GTC GAC GTS CAR CAG AAY GAC AGC GCM ASC TAC ACC AAC (SEQ ID NO: 362) |
| 90-2 RC | GTT GGT GTA GST KGC GCT GTC RTT CTG YTG SAC GTC GAC GAT CTC (SEQ ID NO: 363) |
| 90-3 Forward | AAC GAG TTC CAC YCG YAT YCA GCA ATC GAT CAA CCT CTG GTC G (SEQ ID NO: 364) |
| 90-3 RC | ACC GAA GGC ARG CGC ARC GAC CAG AGG TTG ATC GAT TGC TG (SEQ ID NO: 365) |
| 90-4 Forward | ACC GGC ATC GTR ATG GGY GGM CGR GCC ATM CTC GCC KCC TCG GAC CAA C (SEQ ID NO: 366) |
| 90-4 RC | GTT GGT CCG AGG MGG CGA GKA TGG CYC GKC CRC CCA TYA CGA TGC CGG T (SEQ ID NO: 367) |
| 90-5 Forward | TTC CAG GCC TGG GTM GAC AGY GTG RGC RCC TCG CCS GAY TTC GTC GAY TTC GTY CCC ACC ATC CC (SEQ ID NO: 368) |
| 90-5 RC | GGG ATG GTG GGR ACG AAR TCG ACG AAR TCS GGC GAG GYG CYC ACR CTG TCK ACC CAG GCC TGG AA (SEQ ID NO: 369) |
| 90-6 Forward | TAC GAC CTC AAT GCC GG (SEQ ID NO: 370) |
| 90-6 RC | CCG GCA TTG AGG TCG TA (SEQ ID NO: 371) |
| 90-7 Forward | TAC AAC ACC GAY ACC GCR ATC AAC AAG (SEQ ID NO: 372) |
| 90-7 RC | CTT GTT GAT YGC GGT RTC GGT GTT GTA (SEQ ID NO: 372) |
| 90Aa Frag 8 Reverse | CTC AGT GGT GGT GGT GGT GGT GCT CGA GCT ACT TGC CTA CGA AGG TAC AGG CAT AGA TG (SEQ ID NO: 374) |
| 90Ca Frag 8 Reverse | CTC AGT GGT GGT GGT GGT GGT GCT CGA GTT ACT TGC CGA CGA AAG TGC AGG CAT AGA TG (SEQ ID NO: 375) |

In the third library the native polynucleotide sequence (SEQ ID NO: 1) encoding the IPD090Aa polypeptide (SEQ ID NO: 2) and an *E. coli* codon optimized polynucleotide sequence (SEQ ID NO: 345) encoding the IPD090Ca polypeptide (SEQ ID NO: 6), were used as library parents.

After transforming the library variants into *E. coli* cells, the colonies were picked and cultured in 48-well plates for protein expression. Cell lysates were generated by B-PER® Protein Extraction Reagent from Thermo Scientific (3747 N Meridian Rd, Rockford, Ill. USA 61101) and screened for WCRW insecticidal activity. The active variants were sequenced and the amino acids substitutions were identified. In Library 1, 144 variants were screened and 11 active unique variants were sequence identified. In Library 2, 96 variants were screened and 10 active unique variants were sequence identified. In Library 3, 168 variants were screened and 64 active unique variants were sequence identified.

Percent sequence identity of active IPD090Aa variants to the IPD090Aa polypeptide (SEQ ID NO: 2) was calculated using the Needleman-Wunsch algorithm, as implemented in the Needle program (EMBOSS tool suite). The percent identity compared to the IPD090Aa polypeptide (SEQ ID NO: 2), variant designation, nucleotide sequences, and amino acid sequences of the resulting active IPD090Aa polypeptide variants are shown in Table 10. Table 11 summarizes the % identity of the active variants compared to IPD090Aa polypeptide (SEQ ID NO: 2), the number of variants with each percent identity, and the variant identification.

TABLE 10

| % Identity to IPD090Aa (SEQ ID NO: 2) | Variant | Polynucleotide | Polypeptide |
|---|---|---|---|
| 90.5 | S04515584 | SEQ ID NO: 25 | SEQ ID NO: 114 |
| 84.1 | S04515608 | SEQ ID NO: 26 | SEQ ID NO: 115 |
| 89.9 | S04515618 | SEQ ID NO: 27 | SEQ ID NO: 116 |
| 80.2 | S04515626 | SEQ ID NO: 28 | SEQ ID NO: 117 |
| 81.6 | S04515631 | SEQ ID NO: 29 | SEQ ID NO: 118 |
| 82.2 | S04515638 | SEQ ID NO: 30 | SEQ ID NO: 119 |
| 79.8 | S04515642 | SEQ ID NO: 31 | SEQ ID NO: 120 |
| 81.8 | S04515648 | SEQ ID NO: 32 | SEQ ID NO: 121 |
| 94.2 | S04515711 | SEQ ID NO: 33 | SEQ ID NO: 122 |
| 80.8 | S04515723 | SEQ ID NO: 34 | SEQ ID NO: 123 |
| 80 | S04515724 | SEQ ID NO: 35 | SEQ ID NO: 124 |
| 92.1 | S04519420 | SEQ ID NO: 36 | SEQ ID NO: 125 |
| 84.1 | S04519434 | SEQ ID NO: 37 | SEQ ID NO: 126 |
| 83.9 | S04519435 | SEQ ID NO: 38 | SEQ ID NO: 127 |
| 93.4 | S04519439 | SEQ ID NO: 39 | SEQ ID NO: 128 |
| 87.8 | S04519446 | SEQ ID NO: 40 | SEQ ID NO: 129 |
| 83.9 | S04519447 | SEQ ID NO: 41 | SEQ ID NO: 130 |
| 89 | S04519473 | SEQ ID NO: 42 | SEQ ID NO: 131 |
| 96.7 | S04519475 | SEQ ID NO: 43 | SEQ ID NO: 132 |
| 94.2 | S04519477 | SEQ ID NO: 44 | SEQ ID NO: 133 |
| 83.3 | S04519504 | SEQ ID NO: 45 | SEQ ID NO: 134 |
| 96.9 | S04529311 | SEQ ID NO: 46 | SEQ ID NO: 135 |
| 90.7 | S04529312 | SEQ ID NO: 47 | SEQ ID NO: 136 |
| 89.6 | S04529313 | SEQ ID NO: 48 | SEQ ID NO: 137 |
| 88 | S04529314 | SEQ ID NO: 49 | SEQ ID NO: 138 |
| 88.4 | S04529317 | SEQ ID NO: 50 | SEQ ID NO: 139 |
| 89.9 | S04529318 | SEQ ID NO: 51 | SEQ ID NO: 140 |
| 93 | S04529319 | SEQ ID NO: 52 | SEQ ID NO: 141 |
| 92.4 | S04529320 | SEQ ID NO: 53 | SEQ ID NO: 142 |
| 96.1 | S04529325 | SEQ ID NO: 54 | SEQ ID NO: 143 |
| 93.6 | S04529326 | SEQ ID NO: 55 | SEQ ID NO: 144 |
| 91.7 | S04529329 | SEQ ID NO: 56 | SEQ ID NO: 145 |
| 93.6 | S04529331 | SEQ ID NO: 57 | SEQ ID NO: 146 |
| 95.4 | S04529338 | SEQ ID NO: 58 | SEQ ID NO: 147 |
| 96.3 | S04529347 | SEQ ID NO: 59 | SEQ ID NO: 148 |
| 94.8 | S04529348 | SEQ ID NO: 60 | SEQ ID NO: 149 |
| 89.9 | S04529351 | SEQ ID NO: 61 | SEQ ID NO: 150 |
| 89.2 | S04529352 | SEQ ID NO: 62 | SEQ ID NO: 151 |

TABLE 10-continued

| % Identity to IPD090Aa (SEQ ID NO: 2) | Variant | Polynucleotide | Polypeptide |
|---|---|---|---|
| 86 | S04529353 | SEQ ID NO: 63 | SEQ ID NO: 152 |
| 97.3 | S04529355 | SEQ ID NO: 64 | SEQ ID NO: 153 |
| 86.2 | S04529359 | SEQ ID NO: 65 | SEQ ID NO: 154 |
| 88.8 | S04529361 | SEQ ID NO: 66 | SEQ ID NO: 155 |
| 95.9 | S04529363 | SEQ ID NO: 67 | SEQ ID NO: 156 |
| 86.8 | S04529365 | SEQ ID NO: 68 | SEQ ID NO: 157 |
| 88 | S04529371 | SEQ ID NO: 69 | SEQ ID NO: 158 |
| 90.5 | S04529372 | SEQ ID NO: 70 | SEQ ID NO: 159 |
| 97.3 | S04529374 | SEQ ID NO: 71 | SEQ ID NO: 160 |
| 96.5 | S04529375 | SEQ ID NO: 72 | SEQ ID NO: 161 |
| 83.9 | S04529376 | SEQ ID NO: 73 | SEQ ID NO: 162 |
| 95.2 | S04529377 | SEQ ID NO: 74 | SEQ ID NO: 163 |
| 96.5 | S04529378 | SEQ ID NO: 75 | SEQ ID NO: 164 |
| 85.1 | S04529380 | SEQ ID NO: 76 | SEQ ID NO: 165 |
| 94.2 | S04529383 | SEQ ID NO: 77 | SEQ ID NO: 166 |
| 92.1 | S04529386 | SEQ ID NO: 78 | SEQ ID NO: 167 |
| 94 | S04529390 | SEQ ID NO: 79 | SEQ ID NO: 168 |
| 86 | S04529393 | SEQ ID NO: 80 | SEQ ID NO: 169 |
| 86.2 | S04529396 | SEQ ID NO: 81 | SEQ ID NO: 170 |
| 92.8 | S04529397 | SEQ ID NO: 82 | SEQ ID NO: 171 |
| 94.2 | S04529401 | SEQ ID NO: 83 | SEQ ID NO: 172 |
| 90.3 | S04529402 | SEQ ID NO: 84 | SEQ ID NO: 173 |
| 92.3 | S04529404 | SEQ ID NO: 85 | SEQ ID NO: 174 |
| 90.3 | S04529407 | SEQ ID NO: 86 | SEQ ID NO: 175 |
| 95 | S04529410 | SEQ ID NO: 87 | SEQ ID NO: 176 |
| 97.5 | S04529419 | SEQ ID NO: 88 | SEQ ID NO: 177 |
| 99.4 | S04529422 | SEQ ID NO: 89 | SEQ ID NO: 178 |
| 95.2 | S04529423 | SEQ ID NO: 90 | SEQ ID NO: 179 |
| 95.2 | S04529426 | SEQ ID NO: 91 | SEQ ID NO: 180 |
| 90.3 | S04529432 | SEQ ID NO: 92 | SEQ ID NO: 181 |
| 91.1 | S04529434 | SEQ ID NO: 93 | SEQ ID NO: 182 |
| 93.6 | S04529436 | SEQ ID NO: 94 | SEQ ID NO: 183 |
| 91.3 | S04529437 | SEQ ID NO: 95 | SEQ ID NO: 184 |
| 93.6 | S04529443 | SEQ ID NO: 96 | SEQ ID NO: 185 |
| 98.3 | S04529446 | SEQ ID NO: 97 | SEQ ID NO: 186 |
| 89.9 | S04529447 | SEQ ID NO: 98 | SEQ ID NO: 187 |
| 96.5 | S04529455 | SEQ ID NO: 99 | SEQ ID NO: 188 |
| 97.7 | S04529458 | SEQ ID NO: 100 | SEQ ID NO: 189 |
| 92.1 | S04529460 | SEQ ID NO: 101 | SEQ ID NO: 190 |
| 91.3 | S04529461 | SEQ ID NO: 102 | SEQ ID NO: 191 |
| 93.8 | S04529462 | SEQ ID NO: 103 | SEQ ID NO: 192 |
| 88 | S04529463 | SEQ ID NO: 104 | SEQ ID NO: 193 |
| 93.6 | S04529469 | SEQ ID NO: 105 | SEQ ID NO: 194 |
| 87.4 | S04529471 | SEQ ID NO: 106 | SEQ ID NO: 195 |
| 87.4 | S04529479 | SEQ ID NO: 107 | SEQ ID NO: 196 |
| 91.1 | S04529481 | SEQ ID NO: 108 | SEQ ID NO: 197 |
| 89.4 | S04529483 | SEQ ID NO: 109 | SEQ ID NO: 198 |
| 87 | S04529486 | SEQ ID NO: 110 | SEQ ID NO: 199 |
| 92.1 | S04529493 | SEQ ID NO: 111 | SEQ ID NO: 200 |
| 95.2 | S04529495 | SEQ ID NO: 112 | SEQ ID NO: 201 |
| 87.4 | S04529498 | SEQ ID NO: 113 | SEQ ID NO: 202 |

TABLE 11

| % Iden. to IPD090Aa (SEQ ID NO: 2) | # variants | Variants |
|---|---|---|
| 99 | 1 | S04529422 |
| 98 | 1 | S04529446 |
| 97 | 4 | S04529458, S04529419, S04529355, S04529374 |
| 96 | 7 | S04529311, S04519475, S04529375, S04529378, S04529455, S04529347, S04529325 |
| 95 | 7 | S04529363, S04529338, S04529377, S04529423, S04529426, S04529495, S04529410 |
| 94 | 6 | S04529348, S04515711, S04519477, S04529383, S04529401, S04529390 |
| 93 | 8 | S04529462, S04529326, S04529331, S04529436, S04529443, S04529469, S04519439, S04529319 |

TABLE 11-continued

| % Iden. to IPD090Aa (SEQ ID NO: 2) | # variants | Variants |
|---|---|---|
| 92 | 7 | S04529397, S04529320, S04529404, S04519420, S04529386, S04529460, S04529493 |
| 91 | 5 | S04529437, S04529481, S04529329, S04529434, S04529461 |
| 90 | 6 | S04529312, S04515584, S04529372, S04529402, S04529407, S04529432 |
| 89 | 8 | S04515618, S04529318, S04529351, S04529447, S04529313, S04529483, S04529352, S04519473 |
| 88 | 5 | S04529361, S04529317, S04529314, S04529371, S04529463 |
| 87 | 5 | S04519446, S04529471, S04529479, S04529498, S04529486 |
| 86 | 5 | S04529365, S04529359, S04529396, S04529353, S04529393 |
| 85 | 1 | S04529380 |
| 84 | 2 | S04515608, S04519434 |
| 83 | 4 | S04519435, S04519447, S04529376, S04519504 |
| 82 | 1 | S04515638 |
| 81 | 2 | S04515648, S04515631 |
| 80 | 3 | S04515723, S04515626, S04515724 |
| 79 | 1 | S04515642 |

Example 13—IPD090Aa Variants with Modified Physical Properties

A series of variants of the IPD090Aa polypeptide (SEQ ID NO: 2) with modified physical properties were created by mutagenesis methods using the QuikChange™ Multi Site-Directed Mutagenesis Kit (Agilent). Oligonucleotides were designed and pooled to introduce conservative I to L and Y to F amino acid changes at selected positions within the IPD090Aa polypeptide (SEQ ID NO: 2). The library was expressed in *E. coli* and 204 isolates were screened as cleared lysates for WCRW insecticidal activity. 71 unique WCRW active clones were identified and are summarized in Table 12.

TABLE 12

| Variant | Polynucleotide | Polypeptide | Amino acid sub. compared to IPD090Aa (SEQ ID NO: 2) |
|---|---|---|---|
| S04509867 | SEQ ID NO: 203 | SEQ ID NO: 274 | I038L |
| S04509903 | SEQ ID NO: 204 | SEQ ID NO: 275 | I004L, I038L, I375L |
| S04509914 | SEQ ID NO: 205 | SEQ ID NO: 276 | I340L |
| S04509946 | SEQ ID NO: 206 | SEQ ID NO: 277 | I375L |
| S04513757 | SEQ ID NO: 207 | SEQ ID NO: 278 | I080L |
| S04537215 | SEQ ID NO: 208 | SEQ ID NO: 279 | I080L, Y321F, Y333F, Y434F, I446L, I453L |
| S04537217 | SEQ ID NO: 209 | SEQ ID NO: 280 | I080L, I099L, Y321F, Y333F, I353L, Y434F, I453L |
| S04537221 | SEQ ID NO: 210 | SEQ ID NO: 281 | I080L, Y091F, I099L, I353L, I440L, Y457F |
| S04537226 | SEQ ID NO: 211 | SEQ ID NO: 282 | I080L, Y333F, I340L, I446L, Y457F |
| S04537227 | SEQ ID NO: 212 | SEQ ID NO: 283 | I080L, I099L, Y333F, Y434F |
| S04537230 | SEQ ID NO: 213 | SEQ ID NO: 284 | I080L, Y091F, Y339F, I353L, I440L |
| S04537235 | SEQ ID NO: 214 | SEQ ID NO: 285 | I080L, Y091F, Y321F, Y333F, I340L, I346L, I362L, Y434F, I440L |
| S04537237 | SEQ ID NO: 215 | SEQ ID NO: 286 | I080L, Y333F, Y434F |
| S04537243 | SEQ ID NO: 216 | SEQ ID NO: 287 | I080L, I099L, Y339F, Y457F |
| S04537244 | SEQ ID NO: 217 | SEQ ID NO: 288 | I080L, Y091F, Y333F, I362L, I446L |
| S04537246 | SEQ ID NO: 218 | SEQ ID NO: 289 | I080L, Y333F, I362L |
| S04537249 | SEQ ID NO: 219 | SEQ ID NO: 290 | I080L, Y091F, Y333F, I440L |
| S04537256 | SEQ ID NO: 220 | SEQ ID NO: 291 | I080L, Y091F, I099L, Y321F, Y333F |
| S04537260 | SEQ ID NO: 221 | SEQ ID NO: 292 | I080L, I099L, E331K, K332V, Y333P, R334G, V335Q, K336G, A337, N338, Y339, I340, D341, Q342, L343, V344, V345, I346, T347, G348, G349, S350, S351, T352, I353, E354, P355, P356, V357, G358, Y359, S360, K361, I362, E363, Y364, D365, L366, N367, A368, G369, A370, G371, G372, D373, F374, I375, Y376, L377, C378, Y379, H380, E381, Q382, T383, W384, Q385, A386, D387, R388, P389, K390, D391, A392, V393, T394, D395, I396, R397, I398, I399, F400, N401, K402, E403, P404, T405, P406, P407, G408, Y409, T410, K411, L412, P413, Q414, D415, L416, N417, K418, G419, A420, G421, G422, D423, D424, V425, F426, L427, C428, Y429, K430, T431, E432, A433, Y434, N435, T436, D437, T438, A439, I440, N441, K442, V443, T444, V445, I446, G447, G448, N449, N450, A451, D452, I453, N454, A455, P456, Y457, G458, Y459, L460, K461, V462, P463, G464, D465, L466, N467, R468, G469, A470, G471, G472, N473, F474, I475, Y476, A477, C478, T479, F480, V481, G482 |
| S04537262 | SEQ ID NO: 222 | SEQ ID NO: 293 | I362L, I440L |
| S04537263 | SEQ ID NO: 223 | SEQ ID NO: 294 | I080L, Y091F, Y333F, I362L |
| S04537266 | SEQ ID NO: 224 | SEQ ID NO: 295 | Y091F, Y321F, I440L |
| S04537271 | SEQ ID NO: 225 | SEQ ID NO: 296 | I080L, Y333F, I346L, Y434F, I440L |
| S04537273 | SEQ ID NO: 226 | SEQ ID NO: 297 | I080L, I099L, Y321F, Y333F, I362L, I440L |
| S04537275 | SEQ ID NO: 227 | SEQ ID NO: 298 | I080L, Y339F |
| S04537281 | SEQ ID NO: 228 | SEQ ID NO: 299 | I080L, I099L, Y333F, I353L, Y434F, I446L |
| S04537282 | SEQ ID NO: 229 | SEQ ID NO: 300 | I080L, Y333F, I440L |
| S04537285 | SEQ ID NO: 230 | SEQ ID NO: 301 | I080L, Y091F, Y333F, I346L, I440L, Y457F |
| S04537286 | SEQ ID NO: 231 | SEQ ID NO: 302 | I080L, I340L, I362L, Y434F |
| S04537292 | SEQ ID NO: 232 | SEQ ID NO: 303 | I080L, I340L, I346L, I362L, Y434F |
| S04537293 | SEQ ID NO: 233 | SEQ ID NO: 304 | I080L, I099L, Y333F, I353L |
| S04537294 | SEQ ID NO: 234 | SEQ ID NO: 305 | I080L, I099L, I346L, I362L, I440L |

TABLE 12-continued

| Variant | Polynucleotide | Polypeptide | Amino acid sub. compared to IPD090Aa (SEQ ID NO: 2) |
|---|---|---|---|
| S04537296 | SEQ ID NO: 235 | SEQ ID NO: 306 | I080L, Y091F, I099L, Y321F, Y333F, I340L, S350I, S351Q, T352P, I353S, E354N, P355H, P356R, V357S, G358A, Y359T, S360A, K361R, I362S, E363S, Y364T, D365T, L366S, N367M, A368P, G369V, A370P, G371A, G372V, D373T, F374S, I375S, Y376T, L377C, C378A, Y379I, H380T, E381N, Q382K, T383P, W384G, Q385R, A386P, D387T, R388G, P389L, D391M, A392L, V393, T394, D395, I396, R397, I398, I399, F400, N401, K402, E403, P404, T405, P406, P407, G408, Y409, T410, K411, L412, P413, Q414, D415, L416, N417, K418, G419, A420, G421, G422, D423, D424, V425, F426, L427, C428, Y429, K430, T431, E432, A433, Y434, N435, T436, D437, T438, A439, I440, N441, K442, V443, T444, V445, I446, G447, G448, N449, N450, A451, D452, I453, N454, A455, P456, Y457, G458, Y459, L460, K461, V462, P463, G464, D465, L466, N467, R468, G469, A470, G471, G472, N473, F474, I475, Y476, A477, C478, T479, F480, V481, G482 |
| S04537298 | SEQ ID NO: 236 | SEQ ID NO: 307 | I080L, I340L, I362L, D437A, T438P, A439H, I440S, N441T, K442R, V443S, T444R, V445S, I446S, G447A, G448A, N449T, N450M, A451R, D452I, I453S, N454T, A455L, Y457L, G458V, Y459I, L460, K461, V462, P463, G464, D465, L466, N467, R468, G469, A470, G471, G472, N473, F474, I475, Y476, A477, C478, T479, F480, V481, G482 |
| S04537300 | SEQ ID NO: 237 | SEQ ID NO: 308 | Y333F, I340L, I362L |
| S04537301 | SEQ ID NO: 238 | SEQ ID NO: 309 | I080L, Y091F, I340L |
| S04537303 | SEQ ID NO: 239 | SEQ ID NO: 310 | Y091F, Y333F, I446L |
| S04537304 | SEQ ID NO: 240 | SEQ ID NO: 311 | I080L, Y091F, Y333F, Y434F |
| S04537305 | SEQ ID NO: 241 | SEQ ID NO: 312 | Y091F, Y333F |
| S04537309 | SEQ ID NO: 242 | SEQ ID NO: 313 | I080L, Y091F, I099L, Y339F, I346L, I353L, Y434F, I440L, Y457F |
| S04537312 | SEQ ID NO: 243 | SEQ ID NO: 314 | I080L, Y091F, K319S, H320I, Y321S, D322M, D323T, V324S, W325G, A326R, P327R, A328R, Q329N, S330R, E331K, K332S, Y333S, R334G, V335S, K336R, A337L, N338T, Y339T, I340S, D341T, Q342N, L343W, V344W, V345S, I346S, T347P, G348A, G349V, S350V, S351Q, T352P, I353S, E354N, P355H, P356R, V357S, G358A, Y359T, S360A, K361S, I362S, E363S, Y364T, D365T, L366S, N367M, A368P, G369V, A370P, G371A, G372V, D373T, F374S, I375S, Y376T, L377C, C378A, Y379I, H380T, E381N, Q382K, T383P, W384G, Q385R, A386P, D387T, R388G, P389L, D391M, A392L, V393, T394, D395, I396, R397, I398, I399, F400, N401, K402, E403, P404, T405, P406, P407, G408, Y409, T410, K411, L412, P413, Q414, D415, L416, N417, K418, G419, A420, G421, G422, D423, D424, V425, F426, L427, C428, Y429, K430, T431, E432, A433, Y434, N435, T436, D437, T438, A439, I440, N441, K442, V443, T444, V445, I446, G447, G448, N449, N450, A451, D452, I453, N454, A455, P456, Y457, G458, Y459, L460, K461, V462, P463, G464, D465, L466, N467, R468, G469, A470, G471, G472, N473, F474, I475, Y476, A477, C478, T479, F480, V481, G482 |
| S04537314 | SEQ ID NO: 244 | SEQ ID NO: 315 | I080L, I099L, I346L, I440L |
| S04537315 | SEQ ID NO: 245 | SEQ ID NO: 316 | I080L, Y091F, Y321F, Y333F |
| S04537319 | SEQ ID NO: 246 | SEQ ID NO: 317 | I080L, I099L, Y333F, I362L, I453L |
| S04537321 | SEQ ID NO: 247 | SEQ ID NO: 318 | Y091F, Y333F, I440L, Y457F |
| S04537322 | SEQ ID NO: 248 | SEQ ID NO: 319 | I080L, Y091F, I099L, I346L, I362L, Y434F, I440L |
| S04537325 | SEQ ID NO: 249 | SEQ ID NO: 320 | I080L, Y091F, I099L, Y321F, I346L, Y434F, Y457F |
| S04537326 | SEQ ID NO: 250 | SEQ ID NO: 321 | I080L, Y091F, I099L, A316L, M317C, R318A, K319S, H320I, Y321S, D322M, D323T, V324S, W325G, A326R, P327R, A328R, Q329N, S330R, E331K, K332S, Y333S, R334G, V335S, K336R, A337L, N338T, Y339T, I340S, D341T, Q342N, L343W, V344W, V345S, I346S, T347P, G348A, G349V, S350V, S351Q, T352P, I353S, E354N, P355H, P356R, V357S, G358A, Y359T, S360A, K361R, I362S, E363S, Y364T, D365T, L366S, N367M, A368P, G369V, A370P, G371A, G372V, D373T, F374S, I375S, Y376T, L377C, C378A, Y379I, H380T, E381N, Q382K, T383P, W384G, Q385R, A386P, D387T, R388G, P389L, D391M, A392L, V393, T394, D395, I396, R397, I398, I399, F400, N401, K402, E403, P404, T405, P406, P407, G408, Y409, T410, K411, L412, P413, Q414, D415, L416, N417, K418, G419, A420, G421, G422, D423, D424, V425, F426, L427, C428, Y429, K430, T431, E432, A433, Y434, N435, T436, D437, T438, A439, I440, N441, K442, V443, T444, V445, I446, G447, G448, N449, N450, A451, D452, I453, N454, A455, P456, Y457, G458, Y459, L460, K461, V462, P463, G464, D465, L466, N467, R468, G469, A470, G471, G472, N473, F474, I475, Y476, A477, C478, T479, F480, V481, G482 |

TABLE 12-continued

| Variant | Polynucleotide | Polypeptide | Amino acid sub. compared to IPD090Aa (SEQ ID NO: 2) |
|---|---|---|---|
| S04537328 | SEQ ID NO: 251 | SEQ ID NO: 322 | I080L, Y091F, Y321F, I340L, Y434F, I440L |
| S04537330 | SEQ ID NO: 252 | SEQ ID NO: 323 | I080L, Y091F, Y333F, I446L |
| S04537332 | SEQ ID NO: 253 | SEQ ID NO: 324 | I080L, Y091F, Y333F, Y457F |
| S04537334 | SEQ ID NO: 254 | SEQ ID NO: 325 | I080L, I340L, I440L, Y457F |
| S04537337 | SEQ ID NO: 255 | SEQ ID NO: 326 | I080L, Y091F, Y333F |
| S04537339 | SEQ ID NO: 256 | SEQ ID NO: 327 | Y091F, Y333F |
| S04537347 | SEQ ID NO: 257 | SEQ ID NO: 328 | I080L, Y321F, Y333F, I440L, Y457F |
| S04537349 | SEQ ID NO: 258 | SEQ ID NO: 329 | I080L, Y333F, I446L |
| S04537350 | SEQ ID NO: 259 | SEQ ID NO: 330 | I080L, Y091F, Y333F, I446L |
| S04537351 | SEQ ID NO: 260 | SEQ ID NO: 331 | I080L, I340L, I440L |
| S04537352 | SEQ ID NO: 261 | SEQ ID NO: 332 | Y091F, Y333F, I346L, Y434F, Y457F |
| S04537359 | SEQ ID NO: 262 | SEQ ID NO: 333 | I080L, Y091F, Y339F, I346L, Y434F |
| S04537360 | SEQ ID NO: 263 | SEQ ID NO: 334 | I080L, I099L, Y333F, I362L, Y434F |
| S04537367 | SEQ ID NO: 264 | SEQ ID NO: 335 | I080L, Y091F, Y333F |
| S04537369 | SEQ ID NO: 265 | SEQ ID NO: 336 | I080L, Y091F, I099L, Y333F, Y339F, I346L, I353L, I362L, I440L |
| S04537371 | SEQ ID NO: 266 | SEQ ID NO: 337 | I080L, Y091F, I099L, Y321F, Y333F, Y339F, I346L, Y434F, I453L |
| S04537373 | SEQ ID NO: 267 | SEQ ID NO: 338 | I080L, Y321F, Y333F, Y434F, I446L |
| S04537377 | SEQ ID NO: 268 | SEQ ID NO: 339 | I080L, Y091F, A239T, Y339F, I453L |
| S04537385 | SEQ ID NO: 269 | SEQ ID NO: 340 | I080L, Y333F, Y434F, Y457F |
| S04537389 | SEQ ID NO: 270 | SEQ ID NO: 341 | I080L, Y321F, Y333F, I453L |
| S04537400 | SEQ ID NO: 271 | SEQ ID NO: 342 | I080L, Y091F, Y333F, I353L |
| S04537401 | SEQ ID NO: 272 | SEQ ID NO: 343 | I080L, I099L, Y333F, I353L, I440L |
| S04537402 | SEQ ID NO: 273 | SEQ ID NO: 344 | I080L, Y091F, Y333F, I446L |

Example 14—Mode of Action

Bioactivity of purified recombinant protein incorporated into artificial diet revealed toxicity of IPD090Aa polypeptide (SEQ ID NO: 2) to WCRW larvae. To understand the mechanism of IPD090Aa polypeptide (SEQ ID NO: 2) toxicity, specific binding of the purified protein with WCRW midgut tissue was evaluated by in vitro competition assays. Midguts were isolated from third instar WCRW larvae to prepare brush border membrane vesicles (BBMV) following a method modified from Wolfersberger et al. (*Comp Bioch Physiol* 86A: 301-308, 1987) using amino-peptidase activity to track enrichment. BBMVs represent the apical membrane component of the epithelial cell lining of insect midgut tissue and therefore serve as a model system for how insecticidal proteins interact within the gut following ingestion.

IPD090Aa polypeptide (SEQ ID NO: 2) was re-purified via anion exchange chromatography using a AKTA™ Purifier 10 (GE Life Sciences) with a Frac-950 fraction collector. An aliquot of purified IPD090Aa polypeptide (SEQ ID NO: 2) from Example 4 was taken from −80° C. storage and dialyzed 1 hr. at 4° C. against 20 mM CAPS pH 9.6 ('Eluent A') and loaded onto a 1 mL HiTrap™ Q FF column (GE Life Sciences) equilibrated in Eluent A. A 30 column volume gradient from 0 to 50% Eluent B (20 mM CAPS pH 9.6+1 M NaCl) at 1 mL/min was applied. Fractions near the apex of the elution peak were combined and dialyzed into Binding buffer (50 mM sodium chloride, 2.7 mM potassium chloride, 8.1 mM disodium hydrogen phosphate, and 1.47 mM potassium dihydrogen phosphate, pH 7.5).

The purified IPD090Aa polypeptide (SEQ ID NO: 2) was labeled with Alexa-Fluor® 488 (Life Technologies) and unincorporated fluorophore was separated from labeled protein using buffer exchange resin (Life Technologies, A30006) following manufacturer's recommendations. Prior to binding experiments, proteins were quantified by gel densitometry following Simply Blue® (Thermo Scientific) staining of SDS-PAGE resolved samples that included BSA as a standard.

To demonstrate specific binding and to evaluate affinity, BBMVs (5 µg) were incubated with 6.3 nM of Alexa-labeled IPD090Aa polypeptide (SEQ ID NO: 2) in 100 µL of binding buffer for 1 hr. at RT in the absence and presence of 13 µM of unlabeled IPD090Aa polypeptide (SEQ ID NO: 2). Centrifugation at 20,000×g was used to pellet the BBMVs to separate unbound IPD090Aa polypeptide (SEQ ID NO: 2) remaining in solution. The BBMV pellet was then washed twice with binding buffer to eliminate remaining unbound IPD090Aa polypeptide (SEQ ID NO: 2). The final BBMV pellet (with bound fluorescent protein) was solubilized in reducing Laemmli sample buffer, heated to 100° C. for 5 minutes, and subjected to SDS-PAGE using 4-12% Bis-Tris polyacrylamide gels (Life Technologies). The amount of Alexa-labeled IPD090Aa polypeptide (SEQ ID NO: 2) in the gel from each sample was measured by a digital fluorescence imaging system (ImageQuant™ LAS4000-GE Healthcare). Digitized images were analyzed by densitometry software (Phoretix™ 1 D, TotalLab, Ltd.) FIG. 2 shows that IPD090Aa polypeptide (SEQ ID NO: 2) binds specifically to 5 µg of WCRW BBMVs.

Example 15—Vector Constructs for Expression of IPD090Aa Polypeptides in Plants

Plant expression vectors were constructed to include a transgene cassette containing two different gene designs encoding the IPD090 polypeptide of SEQ ID NO: 377 and one gene design encoding the IPD090 polypeptide of SEQ ID NO: 10 under control of the maize ubiquitin promoter (Christensen, et al., 1992, Christensen and Quail 1996) and linked to the PINII terminator (Keil et al., 1986, *Nucleic Acids Research* 14: 5641-5650; An et al., 1989, The Plant Cell 1: 115-122). The resulting constructs, PHP73234, PHP73237 for the IPD090 polypeptide of SEQ ID NO: 377 and PHP77372 for IPD090 polypeptide of SEQ ID NO: 10, were used to generate transgenic maize events to test for efficacy against corn rootworm provided by expression of these polypeptides.

Example 16—Agrobacterium-Mediated Transformation of Maize and Regeneration of Transgenic Plants For Agrobacterium-mediated transformation of maize with the expression vectors PHP73234, PHP73237, and PHP77372, the method of Zhao was used (U.S. Pat. No. 5,981,840 and PCT Patent Publication Number WO 1998/32326; the contents of which are hereby incorporated by reference). Briefly, immature embryos were isolated from maize and the embryos contacted with a suspension of Agrobacterium under conditions whereby the bacteria are capable of transferring the PHP73234, PHP73237 and PHP77372 vectors to at least one cell of at least one of the immature embryos (step 1: the infection step). In this step the immature embryos were immersed in an Agrobacterium suspension for the initiation of inoculation. The embryos were co-cultured for a time with the Agrobacterium (step 2: the co-cultivation step). The immature embryos were cultured on solid medium following the infection step. Following this co-cultivation period an optional "resting" step is contemplated. In this resting step, the embryos were incubated in the presence of at least one antibiotic known to inhibit the growth of Agrobacterium without the addition of a selective agent for plant transformation (step 3: resting step). The immature embryos were cultured on solid medium with antibiotic, but without a selecting agent, for elimination of Agrobacterium and for a resting phase for the infected cells. Next, inoculated embryos were cultured on medium containing a selective agent and growing transformed callus is recovered (step 4: the selection step). The immature embryos were cultured on solid medium with a selective agent resulting in the selective growth of transformed cells. The callus was then regenerated into plants (step 5: the regeneration step), and calli grown on selective medium or cultured on solid medium to regenerate the plants.

For detection of the IPD090Aa polypeptide (SEQ ID NO: 2) and IPD090Aa (TR1) polypeptide (SEQ ID NO: 10) in leaf tissue 4 lyophilized leaf punches/sample were pulverized and resuspended in 100 μL PBS containing 0.1% Tween 20 (PBST), 1% beta-mercaoptoethanol containing 1 tablet/7 mL complete Mini proteinase inhibitor (Roche 1183615301). The suspension was sonicated for 2 min and then centrifuged at 4° C., 20,000 g for 15 min. To a supernatant aliquot ⅓ volume of 3× NuPAGE® LDS Sample Buffer (Invitrogen™ (CA, USA), 1% beta-mercaoptoethanol containing 1 tablet/7 mL complete Mini proteinase inhibitor was added. The mixture was heated at 80° C. for 10 min and then centrifuged. A supernatant sample was loaded on 4-12% Bis-Tris Midi gels with MES running buffer as per manufacturer's (Invitrogen™) instructions and transferred onto a nitrocellulose membrane using an iBlot® apparatus (Invitrogen™). The nitrocellulose membrane was incubated in PBST containing 5% skim milk powder for 2 hours before overnight incubation in affinity-purified rabbit anti-IPD090Aa (SEQ ID NO: 2) polyclonal antibody in PBST overnight. The membrane was rinsed three times with PBST and then incubated in PBST for 15 min and then two times 5 min before incubating for 2 hours in PBST with goat anti-rabbit-HRP for 3 hours. The detected proteins were visualized using ECL Western Blotting Reagents (GE Healthcare cat #RPN2106) and visualized using a luminescent image analyzer (ImageQuant LAS 4000, GE Healthcare). For detection of the IPD090Aa polypeptide (SEQ ID NO: 2) and IPD090Aa (TR1) polypeptide (SEQ ID NO: 10) in roots the roots were lyophilized and 2 mg powder per sample was resuspended in LDS, 1% beta-mercaptoethanol containing 1 tablet/7 mL Complete Mini proteinase inhibitor was added. The mixture was heated at 80° C. for 10 min and then centrifuged at 4° C., 20,000 g for 15 min. A supernatant sample was loaded on 4-12% Bis-Tris Midi gels with MES running buffer as per manufacturer's (Invitrogen™) instructions and transferred onto a nitrocellulose membrane using an iBlot® apparatus (Invitrogen™). The nitrocellulose membrane was incubated in PBST containing 5% skim milk powder for 2 hours before overnight incubation in affinity-purified polyclonal rabbit anti-IPD090Aa antibody in PBST overnight. The membrane was rinsed three times with PBST and then incubated in PBST for 15 min and then two times 5 min before incubating for 2 hours in PBST with goat anti-rabbit-HRP for 3 hrs. The antibody bound insecticidal proteins were detected using ECL™ Western Blotting Reagents (GE Healthcare cat #RPN2106) and visualized using a luminescent image analyzer (ImageQuant™ LAS 4000, GE Healthcare). Transgenic maize plants positive for expression of the insecticidal proteins are tested for pesticidal activity using standard bioassays known in the art. Such methods include, for example, root excision bioassays and whole plant bioassays. See, e.g., US Patent Application Publication Number US 2003/0120054 and International Publication Number WO 2003/018810.

Example 17—Greenhouse Efficacy of IPD090 Polypeptide Events

Figure 3:
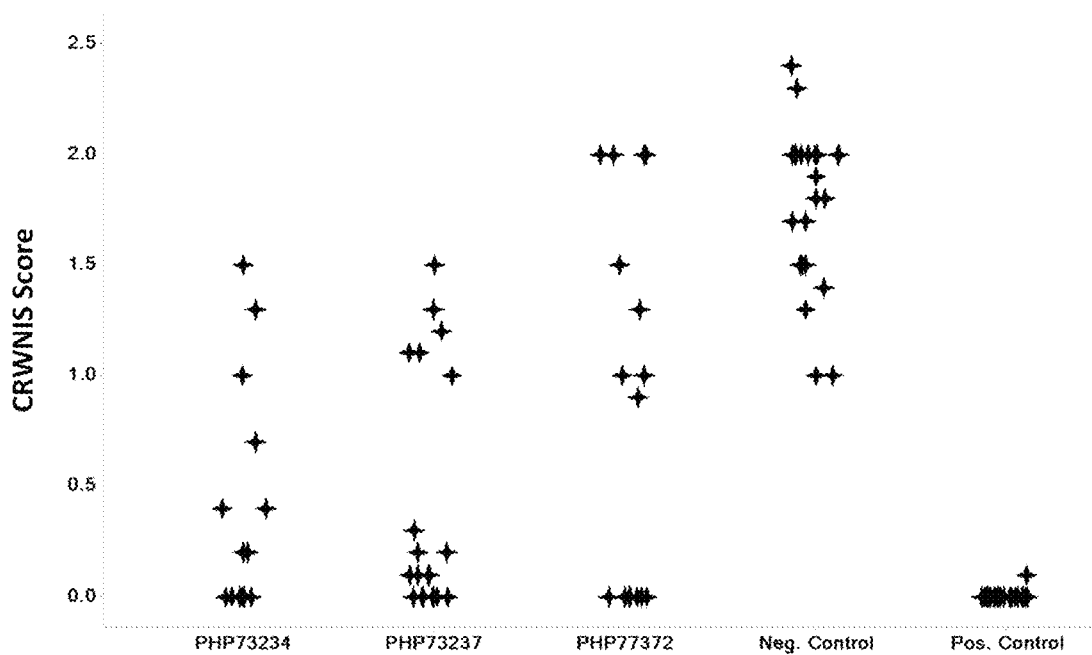

T0 greenhouse efficacy results for events generated from PHP73234, PHP73237 and PHP77372 constructs are shown in FIG. 3. Efficacy for events derived from all 3 constructs was observed relative to negative control events (Empty) as measured by root protection from western corn rootworm. Root protection was measured according to the number of nodes of roots injured (CRWNIS=corn rootworm node injury score) using the method developed by Oleson, et al. (2005) [*J. Econ Entomol.* 98(1):1-8]. The root injury score is measured from "0" to "3" with "0" indicating no visible root injury, "1" indicating 1 node of root damage, "2" indicating 2 nodes or root damage, and "3" indicating a maximum score of 3 nodes of root damage. Intermediate scores (e.g. 1.5) indicate additional fractions of nodes of damage (e.g. one and a half nodes injured). FIG. 3 shows that a large proportion of events from PHP73234, PHP73237 and PHP77372 performed better than the negative control and have rootworm injury scores of <1.0.

Figure 6:
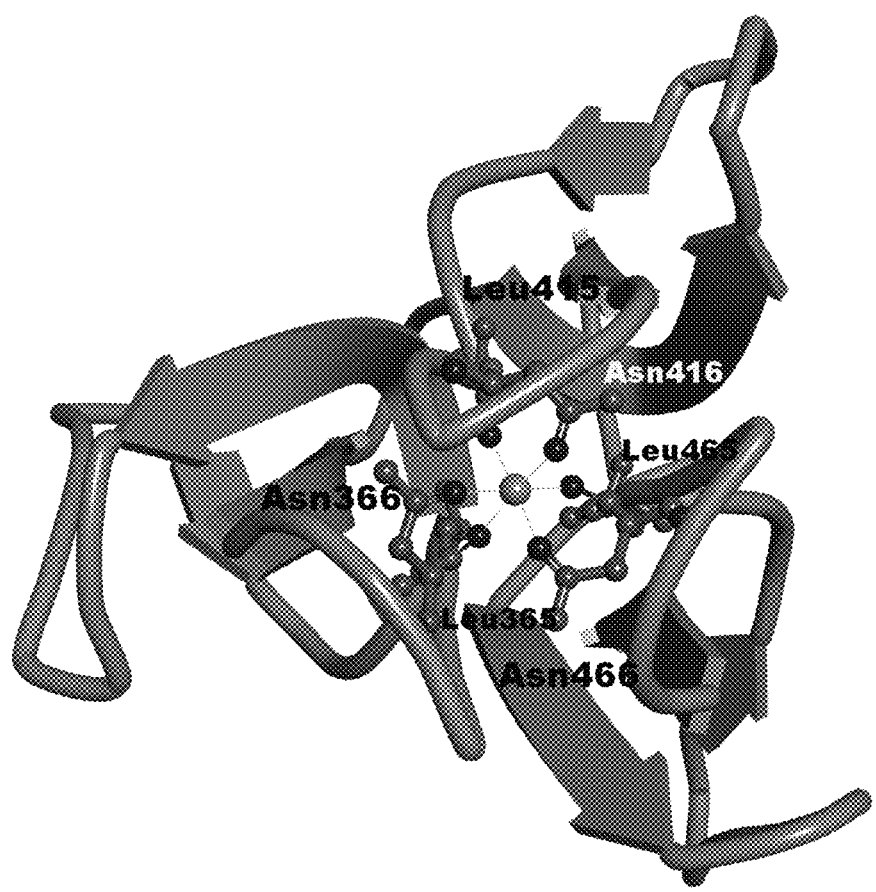
Figure 7:
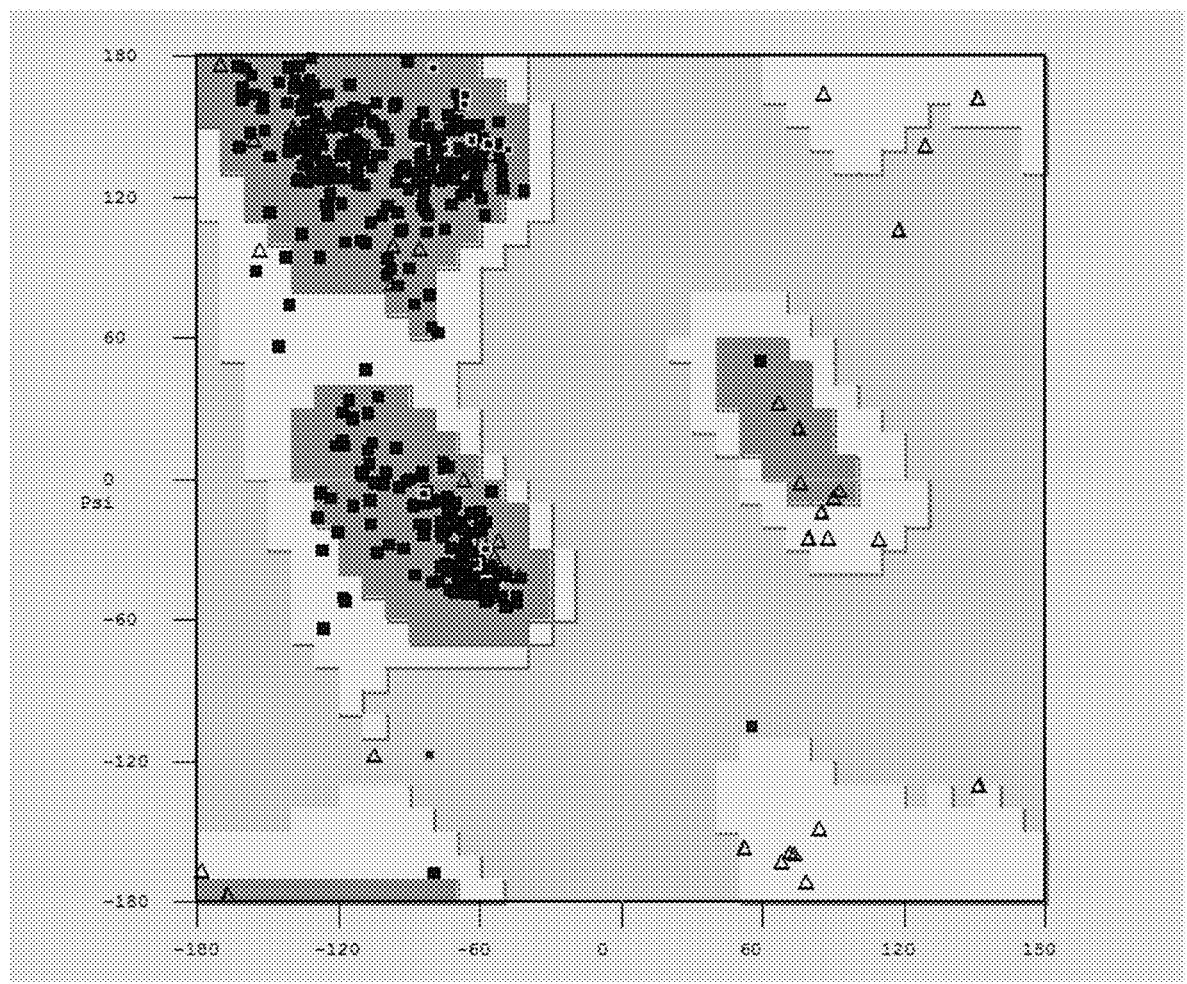

Example 18—Three-Dimensional Structure of IPD090Aa as Determined by X-Ray Crystallography Crystals of IPD090Aa variant 1167 were grown by hanging drop vapor diffusion method at 25° C. Crystals were obtained by mixing 2 ul of a 10 mg/ml protein solution and 2 ul of crystallization solution containing 0.2M $MgCl_2$ hexahydrate, 0.1M HEPES pH=7.5 and 30% PEG 400. Crystals were mounted in 0.5 mM loop and cryoprotected with the addition of ~20% glycerol in the crystallization solution. They were flash frozen in liquid $N_2$ and mounted on a Rigaku Micromax-007 HF x-ray source at Iowa State University Macromolecular X-ray Crystallography facility. 2.1 Å data were collected using an R-Axis IV++ image plate detector at a distance of 165.0 mM. 60° of data were collected at 0.50 image width. Diffraction data was indexed and integrated with iMOSFILM (CCP4 GNU License) (Battye, T. G. G, et al. (2011) *Acta Cryst. D67,* 271-281) (Steller, I et al. (1997) *J. Appl. Cryst.* 30, 1036-1040) and scaled with SCALA (Kabsch, W. 1998) *J. Appl. Cryst.* 21, 916-924. The structure was solved using the molecular replacement program PhaserMR (McCoy, A. J. et al (2007) *J. Appl. Cryst.* 40, 658-674). The structure of a MACPF/perforin-like protein from *Photorhabdus luminescens* (PDB ID 2QP2) (Rosado, C. J. et al. (2007) *Science* 317, 1548-1551) was used as the search model. A suitable solution for the rotation and translation functions was identified. The sequence for IPD090Aa variant 1167 was then built into the electron density using WinCoot© (Emsley P, et al. (2010) ACTA CRYSTALLOGRAPHICA SECTION D-BIOLOGICAL CRYSTALLOGRAPHY 66, 486-501). The model was refined using Refmac5 (Murshudov, G. et al. (1996) in the Refinement of Protein structures, Proceedings of Daresbury Study Weekend;

Murshudov, G. N. et al. (1997) Acta Cryst. D53, 240-255) to an R-factor=0.236 and R-free=0.267 with >96% of amino acids in allowed regions of the Ramachandran Plot. Table 13 shows the data collection and refinement statistics.

an extended β-strand-like conformation. The β-prism domain is made up of three β-stranded antiparallel β-sheets with a β-fold axis running through the center of the domain (FIG. 6). A $Mg^{+2}$ ion is located on this β-fold axis and coordinated by backbone carbonyl atoms from L365, L415, L465 and sidechain carbonyl atoms of N366, N416, and N466. While a role for the $Mg^{+2}$ in insecticidal activity has not been observed, the $Mg^{+2}$ ion fills an anion hole at this location in the molecule and aides in maintaining the arrangement of the 3 antiparallel β-sheets around the β-fold axis.

The above description of various illustrated embodiments of the disclosure is not intended to be exhaustive or to limit the scope to the precise form disclosed. While specific embodiments of and examples are described herein for illustrative purposes, various equivalent modifications are possible within the scope of the disclosure, as those skilled in the relevant art will recognize. The teachings provided herein can be applied to other purposes, other than the

TABLE 13

| Data collection Statistics | | | | | | | |
|---|---|---|---|---|---|---|---|
| Space Group | $P4_12_12$ | | | | | | |
| Resolution | | 2.13 | | | | | |
| Cell Dimensions | a | | b | c | α | β | γ |
| | | 127.61 | 127.61 | 116.12 | 90 | 90 | 90 |
| Reflections | | 244629 | | | | | |
| $R_{merge}$ | | 10.40% | | | | | |
| Completeness (%) | | 99.5 | | | | | |
| I/Sigmal | | 10.8 | | | | | |
| Multiplicity | | 4.6 | | | | | |

| Refinement Statistics | | |
|---|---|---|
| Resolution (Å) | | 2.13 |
| No. reflections | | 51601 |
| $R_{work}/R_{free}$ | | 21.45/24.54 |
| No. Atoms | | |
| | Protein | 3731 |
| | Water | 184 |
| | Ligand | 1 |
| B-factors(Å$^2$) | | 32.84 |
| R.M.S. deviations | | |
| Bond Lengths(Å) | | 0.019 |
| Bond Angles (°) | | 1.943 |
| Ramachadran Plot | | |
| | Favored | 95.62% |
| | Allowed | 3.55% |
| | Outliers | 0.84% |
| Procheck Overall | | |
| G-factor | | −0.1 |

Figure 4:
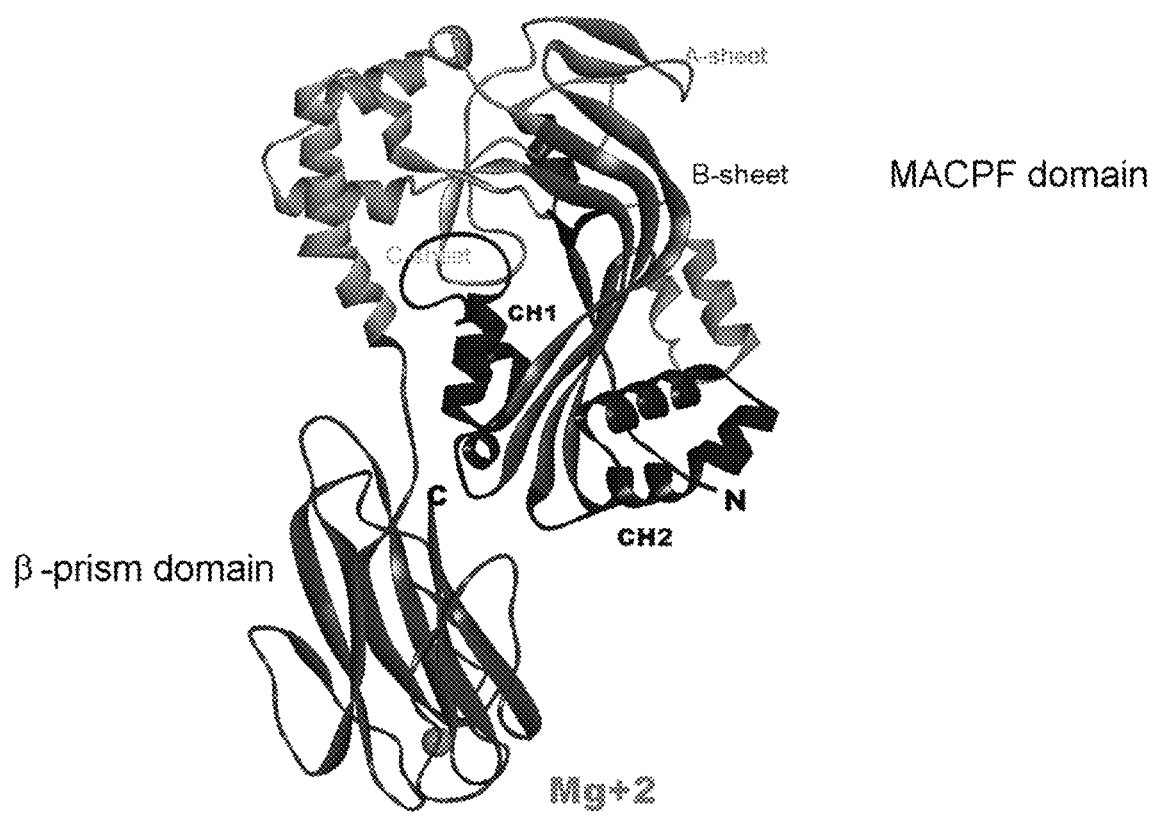
Figure 5:
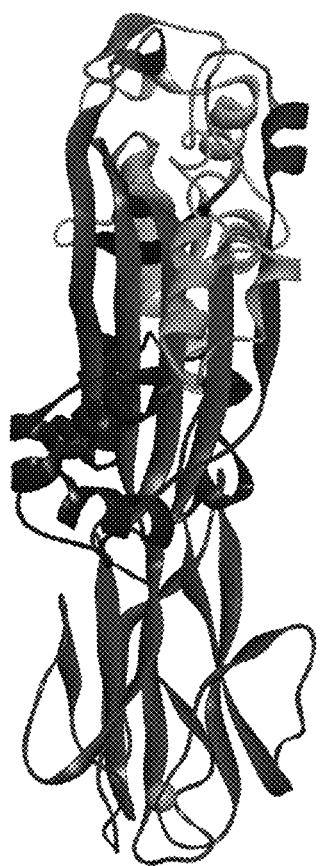

The overall structure of IPD090Aa resembles that of other membrane attack complex/perforin (MACPF) containing proteins. Its N-terminal domain is comprised of the MACPF domain while the C-terminal domain contains the β-prism domain (FIG. 4). Secondary structures are labeled according to Rosado et al (2007 Science 317, 1548-1551). Mg+ atom is shown as a sphere at the bottom of the β-prism domain. The two clusters of helices (CH1 and CH2) are structurally similar to the transmembrane helices (TMH1 and TMH2) of cholesterol-dependent cytolysin (CDC) family of toxins. The overall shape of the N-terminal MACPF domain is somewhat boxed shaped (~42 Å×44 Å×24 Å) with a central L-shaped 4 stranded antiparallel β-sheet and 2 clusters of α-helices. The N-terminal 17 amino acids in the MACPF domain form a 5$^{th}$ member of the central L-shaped β-sheet, but is parallel to strand 4 (FIG. 5). The MACPF domain from *P. luminescens* has an α-helical N-terminus. The C-terminal β-prism domain is located at the bottom of and underneath the central β-sheet. It is connected to the MACPF domain through a five amino acid linker that adopts examples described above. Numerous modifications and variations are possible in light of the above teachings and, therefore, are within the scope of the appended claims.

These and other changes may be made in light of the above detailed description. In general, in the following claims, the terms used should not be construed to limit the scope to the specific embodiments disclosed in the specification and the claims.

The entire disclosure of each document cited (including patents, patent applications, journal articles, abstracts, manuals, books or other disclosures) in the Background, Detailed Description, and Examples is herein incorporated by reference in their entireties.

Efforts have been made to ensure accuracy with respect to the numbers used (e.g. amounts, temperature, concentrations, etc.) but some experimental errors and deviations should be allowed for. Unless otherwise indicated, parts are parts by weight, molecular weight is average molecular weight; temperature is in degrees centigrade; and pressure is at or near atmospheric.

SEQUENCE LISTING (388 sequences)

SEQ ID NO: 1 - DNA, 1449 bp, Pseudomonas sp
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 2 - protein, 483 aa, Pseudomonas sp
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 3 - DNA, 1449 bp, Pseudomonas monteilii
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagagcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 4 - protein, 483 aa, Pseudomonas monteilii
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKSAGGDDVFLCYKTEAYNTDTAINKVTVIGGNNADINAPYGYLKVPGDLNRGAGGNFIYACTFVGK

SEQ ID NO: 5 - DNA, 1449 bp, Pseudomonas entomophila
atggaacacgtcgacctgccgacgggactcgtcaaattttccagcaatcaccatctgcaattgctgcgcgacaccgccgacctcagtgaatcagtgcttccgggcgtagaggccattggcttgggatacaacccattcctcggctacgccggtgtgggaagcggcaccgtccagcttttcgactggaacaacgcaaaaaagaaaaaagtgtcattcaaacccgagttcgtcgtgccggagatcgtcgacgtccagcagaatgacagcgccagctacaccaacatcagtggcaacaccgtcaccgagtatcaacgcagcctggccgtcagcgtggccatcgaaggcaaatacaacttcttcagtggttcgctttcaaccgactacgacgaaaactcgctgcgtaatgccgagaacgagttcacccgtatccagcaatcgatcaacctctggtcgctgcgcctgccttcggtcaaatcactgcgcgacctgatgctgccgcacatgcgtgagcaactggatgagctggacgtgaaaaacccgagtgccatcagccggttcttcgaccgggtgggcagccacttcctcaccggcatcgtgatgggcggccgagccatactcgccgcctcgaccaacaaactgaaggtcaagcgcgactactccgtgtcggtcatcgccaaggcgagctacgaaggcttgaccggccagctgagcgccgaggccaggaccaagtacggcgaatccatgagcagtttcacccagtactccagcacccaccaggaagtccgtggcggcgatggcaccaaggcccatggtgtgttcgagggcaaggccgggttccaggcctgggtcgacagcgtggggacctcgcccgatttcgtcgacttcgtgcccaccatcccgatgctggagatctggagcctgtgcaagaccgattcacaggctgaagccatgaagcgccatttcgacacggtctgggcccgcgaacaatcggacaagtaccggataaaggcgaactacatcgatcagctggtggtaatcaccggtgacagttcgaccatcgaacctccggctggctataccaagattccctacgacctcaatgccggggccaagggcgacttcatctatttgtgctaccacgaacaagcgtggtatcccgacaacaccaaacctgccgtcaccgcgatcaagatcatctacgaccgggaaccggtacccaccgggtatatcaagctgccgcaagacctcaacaaaggcgcaggtggcgcggacatctacctttgctacaagctcgagggctacaacaccgataccgcgatcaacaagatcaccgtgatcagcgggaacaaccccgacattaacgccccctatggctatgagaaagtgccgggcgacctgaacaagggcgcaaaaggcaacttcatctatgcctgcactttcgtcggcaag

SEQ ID NO: 6 - protein, 483 aa, Pseudomonas entomophila
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTVTEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEARTKYGESMSSFTQYSSTHQEVRGGDGTKAHGVFEGKAGFQAWVDSVGTSPDFVDFVPTIPMLEIWSLCKTDSQAEAMKRHFDTVWAREQSDKYRIKANYIDQLVVITGDSSTIEPPAGYTKIPYDLNAGAKGDFIYLCYHEQAWYPDNTKPAVTAIKIIYDREPVPTGYIKLPQDLNKGAGGADIYLCYKLEGYNTDTAINKITVISGNNPDINAPYGYEKVPGDLNKGAKGNFIYACTFVGK

SEQ ID NO: 7 - DNA, 1470 bp, Woodshole amaritima
atgaaaagcctggaccatgtggcacaccagaacctgctgaatgaaccgacccatcataagagcaacaccaaagcggcgctgatgcgccaccaggaaaacctggtggaacgctatctgcctggtgttgaagtgatcggcgccggttacaacccgttcggtgtctacgctagcacggattccgtaactgtacagctgttcgactggcagtctgcgccgtctgaaccggttatcttcaacccggactacatcgcaccaaaagcggtgtctgtgcagcagaacgacgaagcccgttacactaacgtctccggtaagactatcaacacgtttcagaaaaacttcagcctgaaagtgacggtggctggttcttacaacctgttcagcggttctgtgagcaacgaattcagctcttctgaaactcgtaacgctgagaacgaattctcccgtatccagcagagcatccgtgtttggtccctgcgtctggcgtatactgacagcctgcgcgaatacctgaaagcggacgtacgtgactacatcgacagcattcaatccgatgcgcagatcgaaatcctgttcgatcgttacggctctcatttcctgaccggtgtagttatgggcggtgcagctatcatggcgagctccaccaacaaagtgcaggtggaccacacttatgaaaacgaaaccatcgccaaagcgtcttacgaagctctgaccggtcagatcagcgctgaaaccgctgcgaaataccgtcagtctatgagctctttctctcaaaactccgacatccacaagatcgttgttggtggcgatggtgttgctggtgctaaagtgtactctggtgataaagctgattttgatgcgtgggccgataccgtcggtaccagcccggattttgtagattttgtttcctccgtgccgatgctgggtatctgggagctgtgtaaagatgatgcccaggcaaagaaaatggaggactattacaacaacacctgggcgccacgcaagagcaaagaagcgcaaatctacgcggactacatcgatgcagtcgaagtgatccagtccaattccagcggtgttcgcccaccgagcggctacacgaaaatcgattacgatctgaacaaaggtgcaggcggcgactacatctacctgtgctaccataaagctcgctactctgcttactctgaaaacaaagattgcgtttctgacctgatcatcatcaaaggtaacggtgcgcgcgctccaagcggttacactaaaattgatgtggacctgaacgaagatgccggcggcaagtatctgtatctgtgttataaaaaacagtcttacgataacgttgaagcgattaaaggcctggctgtggtaggcggcgacaactctcacactccggctccgtacggctaccgccgtattgacaccgatgtaaacgagggtgctggtggcgaatatatttatatttgctattccaaaggcgcc

SEQ ID NO: 8 - protein, 490 aa, Woodshole amaritima
MKSLDHVAHQNLLNEPTHHKSNTKAALMRHQENLVERYLPGVEVIGAGYNPFGVYASTDSVTVQLFDWQSAPSEPVIFNPDYIAPKAVSVQQNDEARYTNVSGKTINTFQKNFSLKVTVAGSYNLFSGSVSNEFSSSETRNAENEFSRIQQSIRVWSLRLAYTDSLREYLKADVRDYIDSIQSDAQIEILFDRYGSHFLTGVVMGGAAIMASSTNKVQVDHTYENETIAKASYEALTGQISAETAAKYRQSMSSFSQNSDIHKIVVGGDGVAGAKVYSGDKADFDAWADTVGTSPDFVDFVSSVPMLGIWELCKDDAQAKKMEDYYNNTWAPRKSKEAQIYADYIDAVEVIQSNSSGVRPPSGYTKIDYDLNKGAGGDYIYLCYHKARYSAYSENKDCVSDLIIIKGNGARAPSGYTKIDVDLNEDAGGKYLYLCYKKQSYDNVEAIKGLAVVGGDNSHTPAPYGYRRIDTDVNEGAGGEYIYICYSKGA

SEQ ID NO: 9 - DNA, 1380 bp, Artificial Sequence
  IPD090 variant
atggcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 10 - protein, 460 aa, Artificial Sequence
  IPD090 variant
MAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 11 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagcgtgggcacctctccggacttcgtcgatttcgtccctaccatccctatgctggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaagatcacggtcatcagcggcaacaatccggatatcaacgctccttatggttatgagaaggtccctggtgacctgaacaaaggtgctaaaggcaacttcatctatgcctgtaccttcgtaggcaag

SEQ ID NO: 12 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEARTKYGESMSSFTQYSSTHQEVRGGDGTKAHGVFEGKAGFQAWVDSVGTSPDFVDFVPTIPMLEIWSLCKTDSQAEAMKRHFDTVWAREQSDKYRIKANYIDQLVVITGDSSTIEPPAGYTKIPYDLNAGAKGDFIYLCYHEQAWYPDNTKPAVTAIKIIYDREPVPTGYIKLPQDLNKGAGGADIYLCYKLEGYNTDTAINKITVISGNNPDINAPYGYEKVPGDLNKGAKGNFIYACTFVGK

SEQ ID NO: 13 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccctaccatccctatgctggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaagatcacggtcatcagcggcaacaatccggatatcaacgctccttatggttatgagaaggtccctggtgacctgaacaaaggtgctaaaggcaacttcatctatgcctgtaccttcgtaggcaag

SEQ ID NO: 14 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMLEIWSLCKTDSQAEAMKRHFDTVWAREQSDKYRIKANYIDQLVVITGDSSTIEPPAGYTKIPYDLNAGAKGDFIYLCYHEQAWYPDNTKPAVTAIKIIYDREPVPTGYIKLPQDLNKGAGGADIYLCYKLEGYNTDTAINKITVISGNNPDINAPYGYEKVPGDLNKGAKGNFIYACTFVGK

SEQ ID NO: 15 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaagatcacggtcatcagcggcaacaatccggatatcaacgctccttatggttatgagaaggtccctggtgacctgaacaaaggtgctaaaggcaacttcatctatgcctgtaccttcgtaggcaag

SEQ ID NO: 16 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGDSSTIEPPAGYTKIPYDLNAGAKGDFIYLCYHEQAWYPDNTKPAVTAIKIIYDREPVPTGYIKLPQDLNKGAGGADIYLCYKLEGYNTDTAINKITVISGNNPDINAPYGYEKVPGDLNKGAKGNFIYACTFVGK

SEQ ID NO: 17 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaagatcacggtcatcagcggcaacaatccggatatcaacgctccttatggttatgagaaggtccctggtgacctgaacaaaggtgctaaaggcaacttcatctatgcctgtaccttcgtaggcaag

SEQ ID NO: 18 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQAWYPDNTKPAVTAIKIIYDREPVPTGYIKLPQDLNKGAGGADIYLCYKLEGYNTDTAINKITVISGNNPDINAPYGYEKVPGDLNKGAKGNFIYACTFVGK

SEQ ID NO: 19 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgctgatatctacctgtgctacaagctggagggttacaacaccgacaccgcaatcaacaagatcacggtcatcagcggcaacaatccggatatcaacgctccttatggttatgagaaggtccctggtgacctgaacaaaggtgctaaaggcaacttcatctatgcctgtaccttcgtaggcaag

SEQ ID NO: 20 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGADIYLCYKLEGYNTDTAINKITVISGNNPDINAPYGYEKVPGDLNKGAKGNFIYACTFVGK

SEQ ID NO: 21 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaagatcacggtcatcagcggcaacaatccggatatcaacgctccttatggttatgagaaggtccctggtgacctgaacaaaggtgctaaaggcaacttcatctatgcctgtaccttcgtaggcaag

SEQ ID NO: 22 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKITVISGNNPDINAPYGYEKVPGDLNKGAKGNFIYACTFVGK

SEQ ID NO: 23 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggtcgtgccatcctggccgcctctaccaacaagctgaaggtcaagcgtgactactctgtgtctgtgatcgccaaggcgagctacgaaggtctgaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagcgtgggcacctctccggacttcgtcgatttcgtccctaccatccctatgctggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaagatcacggtcatcagcggcaacaatccggatatcaacgctccttatggttatgagaaggtccctggtgacctgaacaaaggtgctaaaggcaacttcatctatgcctgtaccttcgtaggcaag

SEQ ID NO: 24 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEARTKYGESMSSFTQYSSTHQEVRGGDGTKAHGVFEGKAGFQAWVDSVGTSPDFVDFVPTIPMLEIWSLCKTDSQAEAMKRHFDTVWAREQSDKYRIKANYIDQLVVITGDSSTIEPPAGYTKIPYDLNAGAKGDFIYLCYHEQAWYPDNTKPAVTAIKIIYDREPVPTGYIKLPQDLNKGAGGADIYLCYKLEGYNTDTAINKITVISGNNPDINAPYGYEKVPGDLNKGAKGNFIYACTFVGK

SEQ ID NO: 25 - DNA, 1452 bp, Artificial Sequence
  IPD090 variant
atggaacacgtcgacctgccgacgggactcgtcaaattttccagcaatcaccatctgcaattgctgcgcgacaccgccgacctcagtgaatcagtgcttccgggcgtagaggccattggcttgggatacaacccattcctcggctacgccggtgtgggaagcggcaccgtccagcttttcgactggaacaacgcaaaaaagaaaaaagtgtcattcaaacccgagttcgtcgtgccggagatcgtcgacgtccagcagaatgacagcgccagctacaccaacatcagtggcaacaccgtcaccgagtatcaacgcagcctggccgtcagcgtggccatcgaaggcaaatacaacttcttcagtggttcgctttcaaccgactacgacgaaaactcgctgcgtaatgccgagaacgagttcacccgtatccagcaatcgatcaacctctggtcgctgcgcctgccttcggtcaaatcactgcgcgacctgatgctgccgcacatgcgtgagcaactggatgagctggacgtgaaaaacccgagtgccatcagccggttcttcgaccgggtgggcagccacttcctcaccggcatcgtgatgggcggccgagccatactcgccgcctcgaccaacaaactgaaggtcaagcgcgactactccgtgtcggtcatcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccgatgacctcaacagaggtgctggcggcaacttcatctatgcctgtaccttcgtaggcaag

SEQ ID NO: 26 - DNA, 1449 bp, Artificial Sequence
  IPD090 variant
atggaacacgtcgacctgccgacgggactcgtcaaattttccagcaatcaccatctgcaattgctgcgcgacaccgccgacctcagtgaatcagtgcttccgggcgtagaggccattggcttgggatacaacccattcctcggctacgccggtgtgggaagcggcaccgtccagcttttcgactggaacaacgcaaaaaagaaaaaagtgtcattcaaacccgagttcgtcgtgccggagatcgtcgacgtccagcagaatgacagcgccagctacaccaacatcagtggcaacaccgtcaccgagtatcaacgcagcctggccgtcagcgtggccatcgaaggcaaatacaacttcttcagtggttcgctttcaaccgactacgacgaaaactcgctgcgtaatgccgagaacgagttcacccgtatccagcaatcgatcaacctctggtcgctgcgcctgccttcggtcaaatcactgcgcgacctgatgctgccgcacatgcgtgagcaactggatgagctggacgtgaaaaacccgagtgccatcagccggttcttcgaccgggtgggcagccacttcctcaccggcatcgtgatgggcggccgagccatactcgccgcctcgaccaacaaactgaaggtcaagctcgactactccgtgtcggtcatcgccaaggcgagctacgaaggcttgaccggccagctgagcgccgaggccaggaccaagtacggcgaatccatgagcagtttcacccattactccagcacccaccaggaagtccgtggcggcgatggcaccaaggcccatggtgtgttcgagggcaaggccgggttccaggcctgggtcgacagcgtggggacctcgcccgatttcgtcgacttcgtgcccaccatcccgatgctggagatctggagcctgtgcaagaccgattcacaggctgaagccatgaagcgccatttcgacacggtctgggcccgcgaacaatcggacaagtaccggataaaggcgaactacatcgatcagctggtggtaatcaccggtgacagttcgaccatcgaacctccggctggctataccaagattccctacgacctcaatgccggggccaagggcgacttcatctatttgtgctaccacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 27 - DNA, 1452 bp, Artificial Sequence
  IPD090 variant
atggaacacgtcgacctgccgacgggactcgtcaaattttccagcaatcaccatctgcaattgctgcgcgacaccgccgacctcagtgaatcagtgcttccgggcgtagaggccattggcttgggatacaacccattcctcggctacgccggtgtgggaagcggcaccgtccagcttttcgactggaacaacgcaaaaaagaaaaaagtgtcattcaaacccgagttcgtcgtgccggagatcgtcgacgtccagcagaatgacagcgccagctacaccaacatcagtggcaacaccttcaccgagtatcaacgcagcctggccgtcagcgtggccatcgaaggcaaatacaacttcttcagtggttcgctttcaaccgactacgacgaaaactcgctgcgtaatgccgagaacgagttcacccgtatccagcaatcgatcaacctctggtcgctgcgcctgccttcggtcaaatcactgcgcgacctgatgctgccgcacatgcgtgagcaactggatgagctggacgtgaaaaacccgagtgccatcagccggttcttcgaccgggtgggcagccacttcctcaccggcatcgtgatgggcggccgagccatactcgccgcctcgaccaacaaactgaaggtcaagcgcgactactccgtgtcggtcatcgccaaggcgagctacgaaggcttgaccggccagctgagcgccgaggccaggaacaagtacggcgaatccatgagcagtttcacacagtactccagcacccaccaggaagtccgtggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 28 - DNA, 1449 bp, Artificial Sequence
  IPD090 variant
atggaacacgtcgacctgccgacgggactcgtcaaattttccagcaatcaccatctgcaattgctgcgcgacaccgccgacctcagtgaatcagtgcttccgggcgtagaggccattggcttgggatacaacccattcctcggctacgccggtgtgggaagcggcaccgtccagcttttcgactggaacaacgcaaaaaagaaaaaagtgtcattcaaacccgagttcgtcgtgccggagatcgtcgacgtccagcagaatgacagcgccagctacaccaacatcagtggcaacaccgtcaccgagtatcaacgcagcctggccgtcagcgtggccatcgaaggcaaatacaacttcttcagtggttcgctttcaaccgactacgacgaaaactcgctgcgtaatgccgagaacgagttcacccgtatccagcaatcgatcaacctctggtcgctgcgcctgccttcggtgaagtcattgcgcgaactgatgctgccgcacatgcgtgagcaactggatgagctggacgtgaaaaacccgagtgccatcagccggttcttcgaccgggtgggcagccacttcctcaccggcatcgtgatgggcggccgagccatactcgccgcctcgaccaacaagctcagggtcaagcgtgactactcggtgtcggtcatcgccaaggcgagctacgaagggcttaccggccagttgagcgcagaagccaaagccaagtatggcgaatccatgagcagtttcacccagtactccagcacccaccaggaagtccgtggcggcgatggcaccaaggcccatggtgtgttcgagggcaaggccgggttccaggcctgggtcgacagcgtggggacctcgcccgatttcgtcgacttcgtgcccaccatcccgatgctggagatctggagcctgtgcaagaccgattcacaggctgaagccatgaagcgccatttcgacacggtctgggcccgcgaacaatcggacaagtaccggataaaggcgaactacatcgatcagctggtggtaatcaccggtgacagttcgaccatagaacctccggctggctataccaagattccctacgacctcaatgccggggccaagggcgacttcatctatttgtgctaccacgaacaagcgtggtatcccgacaacaccaaacctgccgtcaccgcgatcaagatcatctacgaccgggaaccggtacccaccgggtatatcaagctgccgcaagacctcaacaaaggcgcaggtggcgcggacatctacctttgctacaagctcgagggctacaacaccgataccgcgatcaacaagatcaccgtgatcagcgggaacaaccccgacattaacgccccctatggctatgagaaagtgccgggcgacctgaacaagggcgcaaaaggcaacttcatctatgcctgcactttcgtcggcaag

SEQ ID NO: 29 - DNA, 1449 bp, Artificial Sequence
  IPD090 variant
atggaacacgtcgacctgccgacgggactcgtcaaattttccagcaatcaccatctgcaattgctgcgcgacaccgccgacctcagtgaatcagtgcttccgggcgtagaggccattggcttgggatacaacccattcctcggctacgccggtgtgggaagcggcaccgtccagcttttcgactggaacaacgcaaaaaagaaaaaagtgtcattcaaacccgagttcgtcgtgccggagatcgtcgacgtccagcagaatgacagcgccagctacaccaacatcagtggcaacaccgtcaccgagtatcaacgcagcctggccgtcagcgtggccatcgaaggcaaatacaacttcttcagtggttcgctttcaaccgactacgacgaaaactcgctgcgtaatgccgagaacgagttcacccgtatccagcaatcgatcaacctctggtcgctgcgcctgccttcggtcaaatcactgcgcgacctgatgctgccgcacatgcgtgagcaactggatgagctggacgtgaaaaacccgagtgccatcagccggttcttcgaccgggtgggcagccacttcctcaccggcatcgtgatgggcggccgagccatactcgccgcctcgaccaacaaactgaaggtcaagcgcgactactccgtgtcggtcatcgccaaggcgagctacgaaggcttgaccggccagctgagcgccgaggccaggaccaagtacggcgaatccatgagcagtttcacccagtactccagcacccaccaggaagtccgtggcggcgatggcaccaaggcccatggtgtgttcgagggcaaggccgggttccaggcctgggtcgacagcgtggggacctcgcccgatttcgtcgacttcgtgcccaccatcccgatgctggagatctggagcctgtgcaagaccgattcacaggctgaagccatgaagcgccatttcgacacggtctgggccagcgaacaatcggacaagtaccggataaaggcgaactacatcgatcagctggtggtaatcaccggtgacagttcgaccatcgaacctccggctggctataccaagattccctacgacctcaatgccggggccaagggcgacttcatctatttgtgctaccacgaacaagcgtggtatcccgacaacaccaaacctgccgtcaccgcgatcaagatcatctacgaccgggaaccggtacccaccgggtatatcaagctgccgcaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctaaacagaggtgctggcggcaacttcatctatgcctgtaccttcgtaggcaag

SEQ ID NO: 30 - DNA, 1452 bp, Artificial Sequence
  IPD090 variant
atggaacacgtcgacctgccgacgggactcgtcaaattttccagcaatcaccatctgcaattgctgcgcgacaccgccgacctcagtgaatcagtgcttccgggcgtagaggccattggcttgggatacaacccattcctcggctacgccggtgtgggaagcggcaccgtccagcttttcgactggaacaacgcaaaaaagaaaaaagtgtcattcaaacccgagttcgtcgtgccggagatcgtcgacgtccagcagaatgacagcgccagctacaccaacatcagtggcaacaccgtcaccgagtatcaacgcagcctggccgtcagcgtggccatcgaaggcaaatacaacttcttcagtggttcgctttcaaccgactactacgaaaactcgctgcgtaatgccgagaacgagttcacccgtatccagcaatcgatcaacctctggtcgctgcgcctgccttcggtcaaatcactgcgcgacctgatgctgccgcacatgcgtgagcaactggatgagctggacgtgaaaaacccgagtgccatcagccggttcttcgaccgggtgggcagccacttccttaccggcatcgtaatgggtggacgggccatcatcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcaagaccgattcacaggctgaagccatgaagcgccatttcgacacggtctgggcccgcgaacaatcggacaagtaccggataaaggcgaactacatcgatcagctggtggtaatcaccggtgacagttcgaccatcgaacctccggctggctataccaagattccctacgacctcaatgccggggccaagggcgacttcatctatttgtgctaccacgaacaagcgtggtatcccgacaacaccaaacctgccgtcaccgcgataaagatcatctacgaccgggaaccggtacccaccgggtatatcaagctgccgcaagacctcaacaaaggcgcaggtggcgcggacatctacctttgctacaagctcgagggctacaacaccgataccgcgatcaacaagatcaccgtgatcagcgggaacaaccccgacattaacgccccctatggctatgagaaagtgccgggcgacctgaacaagggcgcaaaaggcaacttcatctatgcctgcactttcgtcggcaag

SEQ ID NO: 31 - DNA, 1449 bp, Artificial Sequence
  IPD090 variant
atggaacacgtcgacctgccgacgggactcgtcaaattttccagcaatcaccatctgcaattgctgcgcgacaccgccgacctcagtgaatcagtgcttccgggcgtagaggccattggcttgggatacaacccattcctcggctacgccggtgtgggaagcggcaccgtccagcttttcgactggaacaacgcaaaaaagaaaaaagtgtcattcaaacccgagttcgtcgtgccggagatcgtcgacgtccagcagaatgacagcgccagctacaccaacatcagtggcaacaccgtcaccgagtatcaacgcagcctggccgtcagcgtggccatcgaaggcaaatacaacttcttcagtggttcgctttcaaccgactacgacgaaaactcgctgagtaatgccgagaacgagttcacccgtatccagcaatcgatcaacctctggtcgctgcgcctgccttcggtcaaatcactgcgcgacctgatgctgccgcacatgcgtgagcaactggatgagctggacgtgaaaaacccgagtgccatcagccggttcttcgaccgggtgggcagccacttcctcaccggcatcgtgatgggcggccgagccatactcgccgcctcgaccaacaaactgaaggtcaagcgcgactactccgtgtcggtcatcgccaaggcgagctacgaaggcttgaccggccagctgagcgccgaggccaggaccaagtacggcgaatccatgagcagtttcacccagtactccagcacccaccaggaagtccgtggcggcgatggcaccaaggcccatggtgtgttcgagggcaaggccgggttccaggcctgggtcgacagcgtggggacctcgcccgatttcgtcgacttcgtgcccaccatcccgatgctggagatctggagcctgtgcaagaccgattcacaggctgaagccatgaagcgccatttcgacacggtctgggcccgcgaacaatcggacaagtaccggataaaggcgaactacatcgatcagctggtggtaatcaccggtgacagttcgaccatcgaaccaccggtcggctacagcaagatcgagtacgacctcaatgccggggccaagggcgacttcatctatttgtgctaccacgaacaagcgtggtatcccgacaacaccaaacctgccgtcaccgagatcaagatcatctacgaccgggaaccggtacccaccgggtatatcaagctgccgcaagacctcaacaaaggcgcaggtggcgcggacatctacctttgctacaagctcgagggctacaacaccgataccgcgatcaacaagatcaccgtgatcagcgggaacaaccccgacattaacgccccctatggctatgagaaagtgccgggcgacctgaacaagggcgcaaaaggcaacttcatctatgcctgtaccttcgtaggcaag

SEQ ID NO: 32 - DNA, 1449 bp, Artificial Sequence
  IPD090 variant
atggaacacgtcgacctgccgacgggactcgtcaaattttccagcaatcaccatctgcaattgctgcgcgacaccgccgacctcagtgaatcagtgcttccgggcgtagaggccattggcttgggatacaacccattcctcggctacgccggtgtgggaagcggcaccgtccagcttttcgactggaacaacgcaaaaaagaaaaaagtgtcattcaaacccgagttcgtcgtgccggagatcgtcgacgtccagcagaatgacagcgccagctacaccaacatcagtggcaacaccgtcaccgagtatcaacgcagcctggccgtcagcgtggccatcgaaggcaaatacaacttcttcagtggttcgctttcaaccgactacgacgaaaactcgctgcgtaatgccgagaacgagttcacccgtatccagcaatcgatcaacctctggtcgctgcgcctgccttcggtcaaatcactgcgcgacctgatgctgccgcacatgcgtgagcaactggatgagctggacgtgaaaaacccgagtgccatcagccggttcttcgaccgggtgggcagccacttcctcaccggcatcgtgatgggcggccgagccatactcgccgcctcgaccaacaaactgaaggtcaagcgcgactactccgtgtcggtggtcgccaaggcgagctacgaaggcttgaccggccagctgagcgccgaggccaggaccaagtacggcgaatccatgagcagtttcacccagtactccagcacccaccaggaagtccgtggcggcgatggcaccaaggcccatggtgtgttcgagggcaaggccgggttccaggcctgggtcgacagcgtggggacctcgcccgatttcgtcgacttcgtgcccaccatcccgatgctggagatctggagcctgtgcaagaccgattcacaggctgaagccatgaagcgccatttcgacacggtctgggcccgcgaacaatcggacaagtaccgggtcaaggctaactacatcgaccaactggtggtcatcaccggcggtagttcaaccatcgaaccaccggtcggctacagcaagatcgagtacgacctcaatgccggggccaagggcgacttcatctatttgtgctaccacgaacaagcgtggtatcccgacaacaccaaacctgccgtcaccgcgatcaagatcatctacgaccgggaaccggtacccaccgggtatatcaagctgccgcaagacctcaacaaaggcgcaggtggcgcggacatctacctttgctacaagctcgagggctacaacaccgataccgcgatcaacaaggtcacggtcatcggcggcaacaatgcggatatcaacgctccctatggttatctgaaggtccccggtgacctcaacagaggtgctggcggcaacttcatctatgcctgcactttcgtcggcaag

SEQ ID NO: 33 - DNA, 1452 bp, Artificial Sequence
  IPD090 variant
atggaacacgtcgacctgccgacgggactcgtcaaattttccagcaatcaccatctgcaattgctgcgcgacaccgccgacctcagtgaatcagtgcttccgggcgtagaggccattggcttgggatacaaccaattcctcggctacgccggtgtgggaagcggcaccgtccagcttttcgactggaacaacgcaaaaaagaaaaaagtgtcattcaaacccgagttcgtcgtgccggagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaatgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgcactttcgtcggcaag

SEQ ID NO: 34 - DNA, 1452 bp, Artificial Sequence
  IPD090 variant
atggaacacgtcgacctgccgacgggactcgtcaaattttccagcaatcaccatctgcaattgctgcgcgacaccgccgacctcagtgaatcagtgcttccgggcgtagaggccattggcttgggatacaacccattcctcggctacgccggtgtgggaagcggcaccgtccagcttttcgactggaacaacgcaaaaaagaaaaaagtgtcattcaaacccgagttcgtcgtgccggagatcgtcgacgtccagcagaatgacagcgccagctacaccaacatcagtggcaacaccgtcaccgagtatcaacgcagcctggccgtcagcgtggccatcgaaggcaaatacaacttcttcagtggttcgctttcaaccgactacgacgaaaactcgctgcgtaatgccgagaacgagttcacccgtatccagcaatcgatcaacctctggtcgctgcgcctgccttcggtcaaatcactgcgcgacctgatgctgccgcacatgcgtgagcaactggatgagctggacgtgaaaaacccgagtgccatcagccggttcttcgaccgggtgggcagccacttcctcaccggcatcgtgatgggcggccgagccatactcgccgcctcgaccaacaaactgaaggtcaagcgcgactactccgtgtcggtcattgccaaggcgagctacgaaggcttgaccggccagctgagcgccgaggccaggaccaagtacggcgaatccatgagcagtttcacccagtactccagcacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatcccgatgctggagatctggagcctgtgcaagaccgattcacaggctgaagccatgaagcgccatttcgacacggtctgggcccgcgaacaatcggacaagtaccggataaaggcgaactacatcgatcagctggtggtaatcaccggtgacagttcgaccatcgaacctccggctggctataccaagattccctacgacctcaatgccggggccaagggcgacttcatctatttgtgctaccacgaacaagcgtggtatcccgacaacaccaaacctgccgtcaccgcgatcaagatcatctacgaccgggaaccggtacccaccgggtatatcaagctgccgcaagacctcaacaaaggcgcaggtggcgcggacatctacctttgctacaagctcgagggctacaacaccgataccgcgatcaacaagatcaccgtgatcagagggaacaaccccgacattaacgccccctatggctatgagaaagtgccgggcgacctgaacaagggcgcaaaaggcaacttcatctatgcctgcactttcgtcggcaag

SEQ ID NO: 35 - DNA, 1449 bp, Artificial Sequence
  IPD090 variant
atggaacacgtcgacctgccgacgggactcgtcaaattttccagcaatcaccatctgcaattgctgcgcgacaccgccgacctcagtgaatcagtgcttccgggcgtagaggccattggcttgggatacaacccattcctcggctacgccggtgtgggaagcggcaccgtccagcttttcgactggaacaacgcaaaaaagaaaaaagtgtcattcaaacccgagttagtcgtgccggagatcgtcgacgtccagcagaatgacagcgccagctacaccaacatcagtggcaacaccgtcaccgagtatcaacgcagcctggccgtcagcgtcgccatcgaaggccgttacaacttcttcagtggctcgctgtccacggatttcgacagtaattcactgcgcaacgcggaaaacgagttcacccgtatccagcaatcgatcaacctctggtcgctgcgcctgccttcggtcaaatcactgcgcgacctgatgctgccgcacatgcgtgagcaactggatgagctggacgtgaaaaacccgagtgccatcagccggttcttcgaccgggtgggcagccacttcctcaccggcatcgtgatgggcggccgagccatactcgccgcctcgaccaacaaactgaaggtcaagcgcgactactccgtgtcggtcatcgccaaggcgagctacgaaggcttgaccggccagctgagcgccgaggccaggaccaagtacggcgaatccatgagcagtttcacccagtactccagcacccaccaggaagtccgtggcggcgatggcaccaaggcccatggtgtgttcgagggcaaggccgggttccaggcctgggtcgacagcgtggggacctcgcccgatttcgtcgacttcgtgcccaccatcccgatgctggagatctggagcctgtgcaagaccgattcacaggctgaagccatgaagcgccatttcgacacggtctgggcccgcgaacaatcggacaagtaccggataaaggcgaactacatcgatcagctggtggtaatcaccggtgacagttcgaccatcgaacctccggctggctataccaagattccctacgacctcaatgccggggccaagggcgacttcatctatttgtgctaccacgaacaagcgtggtatcccgacaacaccaaacctgccgtcaccgcgatcaagatcatctacgaccgggaaccggtacccaccgggtatatcaagctgccgcaagacctcaacaaaggcgcaggtggcgcggacatctacctttgctacaagctcgagggctacaacaccgataccgcgataaacaagatcaccgtgatcagcgggaacaaccccgacattaacgccccctatggctatgagaaagtgccgggcgacctgaacaagggcgcaaaaggcaacttcatctatgcctgcactttcgtcggcaag

SEQ ID NO: 36 - DNA, 1449 bp, Artificial Sequence
  IPD090 variant
atggaacacgtagacttgccacagggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcagagccggctacttcgtacccgagatcgtcgacgtccagcagaacgacagcgcaacctacaccaacgtcagcggcaacacgatcagcgagtaccagcgcagtctggctaccagcgtcgccatcgaaggccgttacaacttcttcagtggttcgctttcaaccgactacgacgaaaactcgctgcgtaatgccgagaacgagttcacccgtatccagcaatcgatcaacctctggtcgctgcgcctgccttcggtgaagtcattgcgcgacctgatgctgccgcacatgcgtgagcaactggatgagctggacgtgaaaaacccgagtgccatcagccggttcttcgaccgggtgggcagccacttcctcaccggcatcgtaatgggtggacgggccatactcgccgcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtcgacagtgtgggcgcctcgcccgatttcgtcgacttcgttcccaccatcccgatgctggagatctggagcctgtgcaagaccgattcacaggctgaagccatgaagcgccatttcgacacggtctgggcccgcgaacaatcggacaagtaccggataaaggcgaactacatcgatcagctggtggtaatcaccggtgacagttcgaccatcgaacctccggctggctataccaagattccctacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgataccgcgatcaacaagatcaccgtgatcagcgggaacaaccccgacattaacgccccctatggctatgagaaagtgccgggcgacctgaacaagggcgcaaaaggcaacttcatctatgcctgcactttcgtcggcaag

SEQ ID NO: 37 - DNA, 1452 bp, Artificial Sequence
  IPD090 variant
atggaacacgtcgacctgccgacaggactcgtcaaattttccagcaatcaccatctgcaattgctgcgcgacaccgccgacctcagtgaatcagtgcttccgggcgtagaggccattggcttgggatacaacccattcctcggctacgccggtgtgggaagcggcaccgtccagcttttcgactggaacaacgcaaaaaagaaaaaagtgtcattcaaacccgagttcgtcgtgcccgagatcgtcgacgtccagcagaatgacagcgcaacctacaccaacatcagtggcaacaccgtcaccgagtatcaacgcagcctggccgtcagcgtggccatcgaaggcaaatacaacttcttcagtggttcgctttcaaccgactacgacgaaaactcgctgcgtaatgccgagaacgagttcacccgtatccagcaatcgatcaacctctggtcgctgcgcctgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggccgggccatcctcgccgcctcgaccaacaagctcagggtcaagcgtgactactcggtgtcggtggtcgccaaggcgagctacgaaggcttgaccggccagctgagcgccgaggccaggaccaagtacggcgaatccatgagcagtttcacccagtactccaatacccaccaggaagtgcgcggcggcgacggtgccaaggcacatggggtgttcagcggcaaaaaagaagatttccaggcctgggtagacagcgtgagcacctcgcccgatttcgtcgacttcgttcccaccatcccgatgctggagatctggagcctgtgcaagaccgattcacaggctgaagccatgaagcgccatttcgacacggtctgggcccgcgaacaatcggacaagtaccggataaaggcgaactacatcgatcagctggtggtaatcaccggtgacagttcgaccatcgaacctccggctggctataccaagattccctacgacctcaatgccggggccaagggcgacttcatctatttgtgctaccacgaacaagcgtggtatcccgacaacaccaaacctgccgtcaccgcgatcaagatcatctacgaccgggaaccggtacccaccgggtatatcaagctgccgcaagacctcaacaaaggcgcaggtggcgcggacatctacctttgctacaagctcgagggctacaacaccgataccgcgatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 38 - DNA, 1449 bp, Artificial Sequence
  IPD090 variant
atggaaaacgtcgacctgccgacgggactcgtcaaattttccagcaatcaccatctgcaattgctgcgcgacaccgccgacctcagtgaatcagtgcttccgggcgtagaggccattggcttgggatacaacccattcctcggctacgccggtgtgggaagcggcaccgtccagcttttcgactggaacaacgcaaaaaagaaaaaagtgtcattcaaacccgagttcgtcgtaccggagatcgtcgacgtgcaacagaacgacagcgccacctacaccaacatcagtggcaacaccgtcaccgagtatcaacgcagcctggccgtcagcgtggccatcgaaggcaaatacaacttcttcagtggttcgctttcaaccgactacgacgaaaactcgctgcgtaatgccgagaacgagttcacccgtatccagcaatcgatcaacctctggtcgttgcgcctgccttcggtcaaatcactgcgcgacctgatgctgccgcacatgcgtgagcaactggatgagctggacgtgaaaaacccgagtgccatcagccggttcttcgaccgggtgggcagccacttccttaccggcatcgtgatgggtggccgagccatactcgcctcctcgaccaacaaactgaaggtcaagcgcgactactccgtgtcggtcatcgccaaggcgagctacgaaggcttgaccggccagctgagcgccgaggccaggaccaagtacggcgaatccatgagcagtttcacccagtactccagcacccaccaggaagtccgtggcggcgatggcaccaaggcccatggtgtgttcgagggcaaggccgggttccaggcctgggtagacagtgtgggcacctcgccggatttcgtcgatttcgttcccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgatcagctggtggtaatcaccggtgacagttcgaccatcgaacctccggctggctataccaagattccctacgacctcaatgccggggccaagggcgacttcatctatttgtgctacaacgaacaagcgtggtatcccgacaacaccaaacctgccgtcaccgcgatcaagatcatctacgaccgggaaccggtacccaccgggtatatcaagctgccgcaagacctcaacaaaggcgcaggtggcgcggacatctacctttgctacaagctcgagggctacaacaccgataccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 39 - DNA, 1452 bp, Artificial Sequence
  IPD090 variant
atggaacacatcgacctgccgacaggactcgtcaaattttccagcaatcaccatctgcaattgctgcgcgacaccgccgacctcagtgaatcagtgcttccgggcgtagaggccattggcttgggatacaacccattcctcggctacgccggtgtgggaagcggcaccgtccagcttttcgactggaacaacgcaaaaaagaaaaaagtgtcattcaaacccgagttcgtcgtgccggagatcgtcgacgtgcagcagaatgacagcgcaagctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcctgccttcggtgaagtcattgcgcgaactgatgctgccacacatgcgccaacaactagatgaattgaacgtcaacgacccgaaggccataagccgctatttcgatagagttggcagccatttccttaccggcatcgtgatgggcggacgagccatactcgcctcctcgaccaacaaactgaaggtcaagcgcgactactccgtgtcggtcatcgccaaggcgagctacgaaggcttgaccggccagctgagcgccgaggccaggaccaagtacggcgagtcgatcagcagcttcactcagtactccaatacccaccaggaagtgcgcggcggcgacggtgccaaggcacatggggtgttcagcggcaaaaaagaagatttccaggcctgggtagacagcgtgggcgcctcgccggatttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggaggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgataccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 40 - DNA, 1446 bp, Artificial Sequence
  IPD090 variant
atggaacacgtagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcagcagaacgacagcgccagctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcctgccttcggtcaaatcactgcgcgacctgatgctgccgcacatgcgtgagcaactggatgagctggacgtgaaaaacccgagtgccatcagccggttcttcgaccgggtgggcagccacttcctcaccggcatcgtaatgggtggccgggccatcctcgcctcctcgaccaacaaactgaaggtcaagcgcgactactccgtgtcggtcatcgccaaggcgagctacgaaggcttgaccggccagctgagcgccgaggccaggaccaagtacggcgaatccatgagcagtttcacccagtactccagcacccaccaggaagtccgtggcggcgatggcaccaaggcccatggtgtgttcgagggcaaggccgggttccaggcctgggtagacagcgtgggcacctcgcccgacttcgtcgacttcgttcccaccatcccgatgctggagatctggagcctgtgcaagaccgattcacaggctgaagccatgaagcgccatttcgacacggtctgggcccgcgaacaatcggacaagtaccggataaaggcgaactacatcgatcagctggtggtaatcaccggtgacagttcgaccatcgaacctccggctggctataccaagattccctacgacctcaatgccggtgccaagggcgacttcatctatttgtgctaccacgaacaagcgtggtatcccgacaacaccaaacctgccgtcaccgcgatcaagatcatctacgaccgggaaccggtacccaccgggtatatcaagctgccgcaagacctcaacaaaggcgcaggtggcgcggacatctacctttgctacaagaccgaggcttacaacaccgacaccgcgatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 41 - DNA, 1449 bp, Artificial Sequence
  IPD090 variant
atggaacacgtcgacctgccgacaggactcgtcaaattttccagcaatcaccatctgcaattgctgcgcgacaccgccgacctcagtgaatcagtgcttccgggcgtagaggccattggcttgggatacaacccattcctcggctacgccggtgtgggaagcggcaccgtccagcttttcgactggaacaacgcaaaaaagaaaaaagtgtcattcaaacccgagttcgtcgtgccggagatcgtcgacgtccagcagaacgacagcgcaacctacaccaacatcagtggcaacaccgtcaccgagtatcaacgcagcctggccgtcagcgtggccatcgaaggcaaatacaacttcttcagtggttcgctttcaaccgactacgacgaaaactcgctgcgtaatgccgagaacgagttcacccgtatccagcaatcgatcaacctctggtcgttgcgcctgccttcggtcaaatcactgcgcgacctgatgctgccgcacatgcgtgagcaactggatgagctggacgtgaaaaacccgagtgccatcagccggttcttcgaccgggtgggcagccacttcctcaccggcatcgtgatgggcggccgagccatcctcgcctcctcgaccaacaaactgaaggtcaagcgcgactactccgtgtcggtcatcgccaaggcgagctacgaaggcttgaccggccagctgagcgccgaggccaggaccaagtacggcgaatccatgagcagtttcacccagtactccagcacccaccaggaagtccgtggcggcgatggcaccaaggcccatggtgtgttcgagggcaaggccgggttccaggcctgggtcgacagcgtgagcacctcgcccgatttcgtcgacttcgtccccaccatccccatgcaggaaatctggaccctgtgcagcagcgaggcgcaggccgaggccatgcgcaagcattacgatgacgtctgggcccgcgaacaatcggacaagtaccggataaaggcgaactacatcgatcagctggtggtaatcaccggtgacagttcaaccatcgaaccaccggtcggctacagcaagatcgagtacgacctcaatgccggggccaagggcgacttcatctatttgtgctaccacgaacaagcgtggtatcccgacaacaccaaacctgccgtcaccgcgatcaagatcatctacgaccgggaaccggtacccaccgggtatatcaagctgccgcaagacctcaacaaaggcgcaggtggcgcggacatctacctttgctacaagctcgagggctacaacaccgacaccgcaatcaacaaggtcacggtcatcggcggcaacaatgcggatatcaacgctccctatggttatctgaaggtccccggtgacctcaacagaggtgctggcggcaacttcatctatgcctgcactttcgtcggcaag

SEQ ID NO: 42 - DNA, 1449 bp, Artificial Sequence
  IPD090 variant
atggaaaacgtagacttgccacagggacttgtaaacttttccacgcaacacctgcaacttattcgttttaaagcaggtttgaatgaaaccgtactacctggcgtcgaagccattggacttggctataacccaatcatcagttatgccagtgtcaacagcggcgcggtgcaattgttcgactgggccacggccaagaaacgcgaagtgcctttcaaacccgagttcgtcgtgccggagatcgtcgacgtccaacagaatgacagcgccacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtgatgggcggccgagccatcctcgccgcctcgaccaacaaactgaatgtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtcgacagtgtgggcgcctcgcccgatttcgtcgatttcgttcccaccatcccgatgctggagatctggagcctgtgcaagaccgattcacaggctgaagccatgaagcgccatttcgacacggtctgggcccgcgaacaatcggacaagtaccggataaaggcgaactacatcgatcagctggtggtaatcaccggtgacagttcgaccatcgaacctccggctggctataccaagattccctacgacctcaatgccggggccaagggcgacttcatctatttgtgctaccacgaacaagcgtggtatcccgacaacaccaaacctgccgtcaccgcgatcaagatcatctacgaccgggaaccggtacccaccgggtatatcaagctgccgcaagacctcaacaaaggcgcaggtggcgcggacatctacctttgctacaagctcgagggctacaacaccgacaccgcgatcaacaagatcaccgtgatcagcgggaacaaccccgacattaacgccccctatggctatgagaaagtgccgggcgacctgaacaagggcgcaaaaggcaacttcatctatgcctgcactttcgtcggcaag

SEQ ID NO: 43 - DNA, 1449 bp, Artificial Sequence
  IPD090 variant
atggaacacgtagacttgccacagggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgccagctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgctgcgcctgccttcggtcaaatcactgcgcgacctgatgctgccgcacatgcgtgagcaactggatgagctggacgtgaaaaacccgagtgccatcagccggttcttcgaccgggtgggcagccacttcctcaccggcatcgtgatgggtggccgggccatcctcgccgcctcgaccaacaaactgaaggtcaagcgtgactactcggtgtcggtggtcgccaaggcgagctacgaagggcttaccggccagctgagcgccgaggccaggaccaagtacggcgaatccatgagcagtttcacccagtactccagcacccaccaggaagtccgtggcggcgacggtgccaaggcacatggggtgttcagcggcaaaaaagaagatttccaggcctgggtagacagtgtgagcgcctcgccggatttcgtcgacttcgttcccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaactatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgataccgcgatcaacaaggtcacggtcatcggcggcaacaatgcggatatcaacgctccctatggttatctgaaggtccccggtgacctcaacagaggtgctggcggcaacttcatctatgcctgcactttcgtcggcaag

SEQ ID NO: 44 - DNA, 1446 bp, Artificial Sequence
  IPD090 variant
atggaacacgtagacttgccacagggacttgtaaacttttccacgcaacacctgcaacttattcgtcttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaatgacagcgcaacctacaccaacatcagtggcaacaccgtcaccgagtatcaacgcagcctggccgtcagcgtggccatcgaaggcaaatacaacttcttcagtggttcgctttcaaccgactacgacgaaaactcgctgcgtaatgccgagaacgagttcacccgtatccagcaatcgatcaacctctggtcgctgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtgatgggcggccgggccatactcgcctcctcgaccaacaaactgaaggtcaagcgcgactactccgtgtcggtcatcgccaaggcgagctacgaaggcttgaccggccagctgagcgccgaggccaggaccaagtacggcgaatccatgagcagtttcacccagtactccagcacccaccaggaagtccgtggcggcgatggcaccaaggcccatggtgtgttcgagggcaaggccgggttccaggcctgggtagacagcgtgagcgcctcgcccgatttcgtcgacttcgttcccaccatccccatgcaggaaatctggaccctgtgcagctgcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgataccgcaatcaacaagatcaccgtgatcagcgggaacaaccccgacattaacgccccctatggctatgagaaagtgccgggcgacctgaacaagggcgcaaaaggcaacttcatctatgcctgcactttcgtcggcaag

SEQ ID NO: 45 - DNA, 1449 bp, Artificial Sequence
  IPD090 variant
atggaaaacatcgacctgccgacaggactcgtcaaattttccagcaatcaccatctgcaattgctgcgcgacaccgccgacctcagtgaatcagtgcttccgggcgtagaggccattggcttgggatacaacccattcctcggctacgccggtgtgggaagcggcaccgtccagcttttcgactggaacaacgcaaaaaagaaaaaagtgtcattcaaacccgagttcgtcgtacccgagatcgtcgacgtccaacagaatgacagcgccacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcctgccttcggtcaaatcactgcgcgacctgatgctgccacacatgcgtgagcaactggatgagctggacgtgaaaaacccgagtgccatcagccggttcttcgaccgggtgggcagccacttcctcaccggcatcgtgatgggtggacgagccatcctcgccgcctcgaccaacaaactgaaggtcaagcgcgactactccgtgtcggtcatcgccaaggcgagctacgaaggcttgaccggccagctgagcgccgaggccaggaccaagtacggcgaatccatgagcagtttcacccagtactccagaacccaccaggaggtccgtggcggcgatggcaccaaggcccatggtgtgttcgagggcaaggccgggttccaggcctgggtagacagtgtgagcgcctcgccggatttcgtcgatttcgtccccaccatcccgatgctggagatctggagcctgtgcaagaccgattcacaggctgaagccatgaagcgccatttcgacacggtctgggcccgcgaacaatcggacaagtaccggataaaggcgaactacatcgatcagctggtggtcatcaccggtgacagttcgaccatcgaacctccggctggttataccaagattccctacgacctcaatgccggtgccggcggtgacttcatctatttgtgctaccacgaacaagcgtggtatcccgacaacaccaaacctgccgtcaccgcgatcaagatcatctacgaccgggaaccggtacccaccgggtatatcaagctgccgcaagacctcaacaaaggcgcaggtggcgcggacatctacctttgctacaagctcgagggctacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 46 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaaggtctgaccggccagctgagcgcagaagcccgtaccaagtatggcgagtctatgagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccttatggttatgagaaggtccctggtgacctcaacagaggtgctggcggcaacttcatctatgcctgtaccttcgtaggcaag

SEQ ID NO: 47 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcatcctacaccaacatcagcggcaacacggtcaccgagtaccagcgcagcctggctgtcagcgtcgccatcgaaggcaaatacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccctaccatccctatgctggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcggtagttcaaccatcgaaccaccggtcggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 48 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcatcctacaccaacatcagcggcaacacggtcaccgagtaccagcgcagcctggctgtcagcgtcgccatcgaaggcaaatacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttccttaccggcatcgtaatgggtggacgggccatcctcgcctcctcgaccaacaagctcagggtcaagcgtgactactctgtgtcggtggtcgccaaggcgagctacgaagggcttaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagcgtgggcacctctccggacttcgtcgatttcgtccccaccatccccatgcaggaaatctggaccctgtgcaaaaccgactctcaggccgaggccatgaaacgtcatttcgataccgtctgggcgcgtgagcaatctgacaagtaccgtatcaaggctaactacatcgaccaactggtggtcatcaccggcgatagctctaccatcgaaccaccggccggctacaccaagatcgagtacgacctgaatgccggtgccaaaggtgacttcatctacctgtgctatcacgaacaagcctggtaccctgacaacactaaacctgctgtgacggctatcaagatcattttcaacaaggagcctaccccacctggctataccaagctgcctcaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 49 - DNA, 1452 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggtctgggctataacccattcctgggttatgccggtgtcggcagcggcacggtgcaactgttcgactggaacaacgccaagaaaaaaaaagtgtctttcaaacctgaattcgtcgtacctgagatcgtcgacgtgcaacagaacgacagcgcatcctacaccaacatcagcggcaacacggtcaccgagtaccagcgcagcctggctgtcagcgtcgccatcgaaggcaaatacaacttcttcagcggctctctgtccacggattacgacgaaaattctctgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatcgtgttggcagccatttcctgaccggcatcgtaatgggtggtcgtgccatcctggccgcctctaccaacaagctcagggtcaagcgtgactactcggtgtcggtggtcgccaaggcgagctacgaaggtctgaccggccagctgagcgcagaagcccgtaccaagtatggcgagtctatgagcagcttcactcagtactccagcacccaccaggaagtgcgcggcggcgacggtgccaaggcacatggggtgttcagcggcaaaaaagaagatttccaggcctgggtagacagcgtgggcacctcttcggacttcgtcgatttcgtccctaccatccctatgctgaaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcggtagttcaaccatcgaaccaccggtcggctacagcaagatcgagtacgacctgaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 50 - DNA, 1449 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggtctgggctataacccattcctgggttatgccggtgtcggcagcggcacggtgcaactgttcgactggaacaacgccaagaaaaaaaaagtgtctttcaaacctgaattcgtcgtacctgagatcgtcgacgtgcaacagaacgacagcgcatcctacaccaacatcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagcgtgggcacctctccggacttcgtcgatttcgtccctaccatccctatgctggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccctggtgacctgaacaaaggtgctaaaggcaacttcatctatgcctgtaccttcgtaggcaag

SEQ ID NO: 51 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcacggtgcaactgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagcggctctctgtccacggatttcgacagtaattcactgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagcgtgggcacctctccggacttcgtcgatttcgtccctaccatccctatgctggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcgatagctctaccatcgaaccaccggccggctacaccaagatcccgtacgacctgaatgccggtgccggcggtgacttcatctacttgtgctatcacgaacaaacctggcaggccgacaggcctaaagatgctgtgacggatatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 52 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggacgggccatcctcgcctcctcgaccaacaagctcagggtcaagcgtgactactctgtgtctgtgatcgccaaggcgagctacgaaggtctgaccggccagctgagcgcagaagcccgtaccaagtatggcgagtctatgagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaaggtcacggtcatcggcggcaacaatccggatatcaacgctccttatggttatgagaaggtccctggtgacctgaacaaaggtgctaaaggcaacttcatctatgcctgtaccttcgtaggcaag

SEQ ID NO: 53 - DNA, 1452 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggtctgggctataacccattcctgggttatgccggtgtcggcagcggcacggtgcaactgttcgactggaacaacgccaagaaaaaaaaagtgtctttcaaacctgaattcgtcgtacctgagatcgtcgacgtgcaacagaacgacagcgcatcctacaccaacatcagcggcaacacggtcaccgagtaccagcgcagcctggctgtcagcgtcgccatcgaaggccgttacaacttcttcagtggctcgctgtccacggatttcgacagtaattcactgcgcaacgcggaaaacgagtttactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttcctgaccggcatcgtaatgggtggtcgtgccatcctggccgcctctaccaacaagctgaaggtcaagcgtgactactctgtgtctgtgatcgccaaggcgagctacgaaggtctgaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctatatcaagctgccccaggacctgaacaagggcgcgggcggtgatgatgtattcctctgctacaagaccgaggcttacaacaccgacaccgcaatcaacaaggtcacggtcatcggcggcaacaatccggatatcaacgctccttatggttatctgaaggtccccggtgacctcaacagaggtgctggcggcaacttcatctatgcctgtaccttcgtaggcaag

SEQ ID NO: 54 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgtctttcaaacctgaattcgtcgtacctgagatcgtcgacgtgcaacagaacgacagcgcatcctacaccaacatcagcggcaacacggtcaccgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccagcacccaccaggaagtgcgcggcggcgacggtaccaaggcacatggtgtgttcgaaggcaaagcaggtttccaggcctgggtagacagcgtgggcacctctccggacttcgtcgatttcgtccctaccatccctatgctggaaatctggtccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 55 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcatcctacaccaacatcagcggcaacacggtcaccgagtaccagcgcagcctggctgtcagcgtcgccatcgaaggcaaatacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggtcgtgccatcctggccgcctctaccaacaagctgaaggtcaagcgtgactactctgtgtctgtgatcgccaaggcgagctacgaaggtctgaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagcgtgggcacctctccggacttcgtcgatttcgtccctaccatccctatgctggaaatctggtccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 56 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacgaaaattctctgcgcaacgcggaaaacgagttcactcgcattcagcaatcgatcaacctctggtcgttgcgcctgccttctgtgaagtctctgcgcgacctgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtctatgagcagcttcactcagtactccagcacccaccaggaagtgcgcggcggcgacggtaccaaggcacatggtgtgttcgaaggcaaagcaggtttmcaggcctgggtagacagcgtgggcacctstccggayttcgtcgatttcgtccccaccatccccatgcaggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcgatagctctaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgctgatatctacctgtgcttcaagctggagggttacaacaccgacaccgcaatcaacaagatcacggtcatcagcggcaacaatccggatatcaacgctccttatggttatgagaaggtccctggtgacctgaacaaaggtgataaaggcaacttcatctatgcctgtaccttcgtaggcaag

SEQ ID NO: 57 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgacctgatgctgccacacatgcgcgaacaactggatgaactggacgtcaaaaacccgagcgccatcagccgctttttcgatcgtgttggcagccatttcctgaccggcatcgtaatgggtggtcgtgccatcctggccgcctctaccaacaagctgaaggtcaagcgtgactactcggtgtcggtggtcgccaaggcgagctacgaagggctgaccggccagctgagcgcagaaacccgtaccaagtatggcgagtctatgagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccctaccatccctatgctggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatatctacctgtgctacaagctggagggttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 58 - DNA, 1449 bp, Artificial Sequence
  IPD090 variant
atggaaaacatagacttgccacaaggacttgtaaacttttccaagcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcatcctacaccaacatcagcggcaacacggtcaccgagtaccagcgcagcctggctaccagcgtcgccatcgaaggccgttacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggtcgtgccatcctggccgcctctaccaacaagctgaaggtcaagcgtgactactctgtgtcggtggtcgccaaggcgagctacgaagggcttaccggccagttgagcgcagaagccaaagccaagtatggcgagtcgatcagcagcttcactcagtactccagcacccaccaggaagtgcgcggcggcgacggtaccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcgatagctctaccatcgaaccaccggccggctacaccaagatcccgtacgacctgaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 59 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacatcagcggcaacacgatcagcgagtaccagcgcagtctggctaccagcgtcgccatcgaaggccgttacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgaaggccataagccgctatttcgatagagttggcagccatttcctgaccggcatcgtaatgggtggtcgtgccatcctggccgcctctaccaacaagctgaaggtcaagcgtgactactctgtgtctgtgatcgccaaggcgagctacgaaggtctgaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcgatagctctaccatcgaaccaccggccggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaagatcacggtcatcagcggcaacaatccggatatcaacgctccctatggttatctgaaggtccccggtgacctgaacaaaggtgctaaaggcaacttcatctatgcctgtaccttcgtaggcaag

SEQ ID NO: 60 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgaaacgtcatttcgataccgtctgggcgcgtgagcaatctgacaagtaccgtatcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 61 - DNA, 1452 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggtctgggctataacccattcctgggttatgccggtgtcggcagcggcacggtgcaactgttcgactgggccacggccaagaaacgcgaagtgcctttcaaagccggctacttcgtacccgagatcgtcgacgtgcaacagaacgacagcgcatcctacaccaacatcagcggcaacacggtcaccgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactctgtgtctgtgatcgccaaggcgagctacgaaggtctgaccggccagctgagcgcagaagcccgtaccaagtatggcgagtctatgagcagcttcactcagtactccaatacccaccaggaagtgcgcggcggcgacggtaccaaggcacatggggtgttcagcggcaaaaaagaagatttccaggcctgggtagacagtgtgagcgcctcgccggacttcgtcgatttcgtccctaccatccctatgctggaaatctggtccctgtgcagcagcgaggcgcaggccgaggccatgcgcaagcattacgatgacgtctgggcgccggcgcaatcggaaaagtaccgggtcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgatggctatcaagatcatttacgaccgtgagcctgtcccaactggctatatcaagctgcctcaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 62 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcatcctacaccaacatcagcggcaacacgatcagcgagtaccagcgcagtctggctgtcagcgtcgccatcgaaggcaaatacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggtcgtgccatcctggccgcctctaccaacaagctgaaggtcaagcgtgactactctgtgtctgtgatcgccaaggcgagctacgaaggtctgaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagcgtgggcacctctccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaagatcacggtcatcagcggcaacaatccggatatcaacgctccttatggttatgagaaggtccctggtgacctgaacaaaggtgctaaaggcaacttcatctatgcctgtaccttcgtaggcaag

SEQ ID NO: 63 - DNA, 1449 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggtctgggctataacccattcctgggttatgccggtgtcggcagcggcacggtgcaactgttcgactggaacaacgccaagaaaaaaaaagtgtctttcaaacctgaattcgtcgtacctgagatcgtcgacgtgcaacagaacgacagcgcatcctacaccaacgtcagcggcaacacggtcaccgagtaccagcgcagcctggctgtcagcgtcgccatcgaaggcaaatacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggtcgtgccatcctggccgcctctaccaacaagctgaaggtcaagcgtgactactctgtgtctgtgatcgccaaggcgagctacgaaggtctgaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagtgtgagcgcctcgccggacttcgtcgatttcgtccctaccatccctatgctggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcgatagctctaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 64 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacctgagatcgtcgacgtgcaacagaacgacagcgcatcctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagcgtgggcacctctccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggccggctacaccaagatcccgtacgacctgaatgccggtgccaaaggtgacttcatctacctgtgctatcacgaacaagcctggtaccctgacaacactaaacctgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 65 - DNA, 1449 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggtctgggctataacccattcctgggttatgccggtgtcggcagcggcacggtgcaactgttcgactggaacaacgccaagaaaaaaaaagtgtctttcaaacctgaattcgtcgtacctgagatcgtcgacgtgcaacagaacgacagcgcatcctacaccaacatcagcggcaacacggtcaccgagtaccagcgcagtctggctaccagcgtcgccatcgaaggccgttacaacttcttcagtggctcgctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggtcgtgccatcctggccgcctctaccaacaagctcagggtcaagcgtgactactcggtgtcggtggtcgccaaggcgagctacgaaggtctgaccggccagctgagcgcagaagccaaagccaagtatggcgagtcgatcagcagcttcactcagtactccaatacccaccaggaagtgcgcggcggcgacggtaccaaggcacatggtgtgttcgaaggcaaagcaggtttccaggcctgggtagacagcgtgggcacctctccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctataccaagctgccccaggacctgaacaagggcgcgggcggtgatgatgtattcctctgctacaagaccgaggcttacaacaccgacaccgcaatcaacaagatcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 66 - DNA, 1449 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggtctgggctataacccattcctgggttatgccggtgtcggcagcggcacggtgcaactgttcgactggaacaacgccaagaaaaaaaaagtgtctttcaaacctgaattcgtcgtacctgagatcgtcgacgtgcaacagaacgacagcgcatcctacaccaacatcagcggcaacacggtcaccgagtaccagcgcagcctggctgtcagcgtcgccatcgaaggccgttacaacttcttcagcggctctctgtccacggattacgacgaaaattctctgcgcaacgcggaaaacgagttcactcgcattcagcaatcgatcaacctctggtcgttgcgcttgccttcggtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggtcgtgccatcctggccgcctctaccaacaagctgaaggtcaagcgtgactactctgtgtctgtgatcgccaaggcgagctacgaagggcttaccggccagttgagcgcagaagccaaagccaagtatggcgagtcgatcagcagcttcactcagtactccagcacccaccaggaagtgcgcggcggcgacggtaccaaggcacatggtgtgttcgaaggcaaagcaggtttccaggcctgggtagacagcgtgggcacctctccggacttcgtcgatttcgtccctaccatccctatgctggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctgaatgccggtgccaaaggtgacttcatctacctgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 67 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatctatcaacctgtggtctctgcgcctgccttcggtgaagtcattgcgcgaactgatgctgccacacatgcgccaacaactagatgaattgaacgtcaacgacccgaaggccataagccgctatttcgatagagttggcagccatttcctgaccggcatcgtaatgggtggtcgtgccatcctgaccgcctctaccaacaagctgaaggtcaagcgtgactactctgtgtcggtggtcgccaaggcgagctacgaagggcttaccggccagttgagcgcagaagccaaagccaagtatggcgagtcgatcagcagcttcactcagtactccagcacccaccaggaagtgcgcggcggcgacggtaccaaggcacatggtgtgttcagcggcaaaaaagaagatttccaggcctgggtagacagcgtgggcacctctccggacttcgtcgatttcgtccccaccatccccatgcaggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcggtagttcaaccatcgaaccaccggtcggctacagcaagatcgagtacgacctcaatgccggtgccggcggtgacttcatctacctgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 68 - DNA, 1452 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggtctgggctataacccattcctgggttatgccggtgtcggcagcggcacggtgcaactgttcgactggaacaacgccaagaaaaaaaaagtgtctttcaaacctgaattcgtcgtacctgagatcgtcgacgtgcaacagaacgacagcgcatcctacaccaacatcagcggcaacacggtcaccgagtaccagcgcagcctggctgtcagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccctatgctggaaatctggaccctgtgcaaaaccgactctcaggccgaggccatgaaacgtcatttcgataccgtctgggcgccggcgcaatcggaaaagtaccgggtcaaggctaactacatcgaccaactggtggtcatcaccggcggtagttcaaccatcgaaccaccggtcggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaagatcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 69 - DNA, 1452 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggtctgggctataacccattcctgggttatgccggtgtcggcagcggcacggtgcaactgttcgactggaacaacgccaagaaaaaaaaagtgtctttcaaacctgaattcgtcgtacctgagatcgtcgacgtgcaacagaacgacagcgcaacctacaccaacgtcagcggcaacacgatcagcgagtaccagcgcagtctggctgtcagcgtcgccatcgaaggcaaatacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttccttaccggcatcgtaatgggtggtcgtgccatcctggccgcctctaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcaaaaccgactctcaggccgaggccatgaaacgtcatttcgataccgtctgggcgcgtgagcaatctgacaagtaccgtatcaaggctaactacatcgaccaactggtggtcatcaccggcggtagttcgaccatcgaaccaccggtcggctacagcaagatcgagtacgacctcaatgccggtgccggcggtgacttcatctacttgtgctatcacgaacaagcctggtaccctgacaacactaaacctgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatccggatatcaacgctccctatggttatctgaaggtccccggtgacctcaacagaggtgctggcggcaacttcatctatgcctgtaccttcgtaggcaag

SEQ ID NO: 70 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagcggctctctgtccacggattacgacgaaaattctctgcgcaacgcggaaaacgagttcactcgcattcagcaatctatcaacctgtggtctctgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaaggtctgaccggccagttgagcgcagaagccaaagccaagtatggcgagtcgatcagcagcttcactcagtactccaatacccaccaggaagtgcgcggcggcgacggtgccaaggcacatggtgtgttcgaaggcaaagcaggtttccaggcctgggtagacagcgtgggcacctctccggacttcgtcgatttcgtccctaccatccctatgctggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgccccaggacctgaacaagggcgcgggcggtgatgatgtattcctctgctacaagctggagggttacaacaccgacaccgcaatcaacaagatcacggtcatcggcggcaacaatgcggatatcaacgctccttatggttatgagaaggtccctggtgacctcaacagaggtgctggcggcaacttcatctatgcctgtaccttcgtagacaag

SEQ ID NO: 71 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactctgtgtctgtgatcgccaaggcgagctacgaaggtctgaccggccagctgagcgcagaagcccgtaccaagtatggcgagtctatgagcagcttcactcagtactccagcacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcgatagctctaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgcctcaggacctgaacaagggcgcgggcggtgctgatatctacctgtgctacaagctggagggttacaacaccgacaccgcaatcaacaagatcacggtcatcagcggcaacaatgcggatatcaacgctccctatggttatctgaaggtccccggtgacctcaacagaggtgctggcggcaacttcatctatgcctgtaccttcgtaggcaag

SEQ ID NO: 72 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcatcctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatctatcaacctgtggtctctgcgcctgccttctgtgaagtctctgcgcgacctgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtctgtgatcgccaaggcgagctacgaaggtctgaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagtgtgggcacctctccggacttcgtcgatttcgtccctaccatccctatgctggaaatctggaccctgtgcagcagcgaggcgcaggccgaggccatgcgcaagcattacgatgacgtctgggcgccggcgcaatcggaaaagtaccgggtcaaggctaactgcatcgaccaactggtggtcatcaccggcgatagctctaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 73 - DNA, 1449 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggtctgggctataacccattcctgggttatgccggtgtcggcagcggcacggtgcaactgttcgactggaacaacgccaagaaaaaaaaagtgtctttcaaacctgaattcgtcgtacctgagatcgtcgacgtgcaacagaacgacagcgcatcctacaccaacatcagcggcaacacggtcaccgagtaccagcgcagcctggctgtcagcgtcgccatcgaaggccgttacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttccttaccggcatcgtaatgggtggacgtgccatcctggccgcctctaccaacaagctgaaggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggtgtgttcgaaggcaaagcaggtttccaggcctgggtagacagtgtgagcgcctcgccggacttcgtcgatttcgtccctaccatccctatgctggaaatctggtccctgtgcaaaaccgactctcgggccgaggccatgaaacgtcatttcgataccgtctgggcgcgtgagcaatctgacaagtaccgtatcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggtaccctgacaacactaaacctgctgtgacggctatcaagatcatttacgaccgtgagcctgtcccaactggctataccaagctgccccaggacctgaacaagggcgcgggcggtgatgatgtattcctctgctacaagaccgaggcttacaacaccgacaccgcaatcaacaaggtcacggtcatcggcggcaacaatccggatatcaacgctccttatggttatgagaaggtccctggtgacctgaacaaaggtgctaaaggcaacttcatctatgcctgtaccttcgtaggcaag

SEQ ID NO: 74 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaagatcacggtcatcagcggcaacaatccggatatcaacgctccttatggttatgagaaggtccctggtgacctgaacaaaggtgctaaaggcaacttcatctatgcctgtaccttcgtaggcaag

SEQ ID NO: 75 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgccaacaactagatgaattgaacgtcaacgacccgaaggccataagccgctatttcgatcgtgttggcagccatttcctgaccggcatcgtaatgggtggtcgtgccatcctggccgcctctaccaacaagctgaaggtcaagcgtgactactctgtgtctgtgatcgccaaggcgagctacgaaggtctgaccggccagctgagcgcagaagcccgtaccaagtatggcgagtctatgagcagcttcactcagtactccaatacccaccaggaagtgcgcggcggcgacggtaccaaggcacatggtgtgttcgaaggcaaagcaggtttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccttatggttatgagaaggtccctggtgacctgaacaaaggtgctaaaggcaacttcatctatgcctgtaccttcgtaggcaag

SEQ ID NO: 76 - DNA, 1449 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacggtcaccgagtaccagcgcagcctggctgtcagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgcgaacaactagatgaactggacgtcaaaaacccgagcgccatcagccgctttttcgatcgtgttggcagccatttccttaccggcatcgtaatgggtggacgggccatcctcgcctcctcgaccaacaagctcagggtcaagcgtgactactctgtgtctgtgatcgccaaggcgagctacgaaggtctgaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagcgtgggcacctctccggacttcgtcgatttcgtccctaccatccctatgctggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgatgatgtattcctctgctacaagaccgaggcttacaacaccgacaccgcaatcaacaaggtcacggtcatcagcggcaacaatccggatatcaacgctccttatggttatgagaaggtccctggtgacctgaacaaaggtgctaaaggcaacttcatctatgcctgtaccttcgtaggcaag

SEQ ID NO: 77 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggtcgtgccatcctggccgcctctaccaacaagctgaaggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcgatagctctaccatcgaaccaccggccggctacaccaagatcccgtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgcctcaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 78 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccggtgtcggcagcggcacggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcaccgagtaccagcgcagtctggctaccagcgtcgccatcgaaggccgttacaacttcttcagtggctcgctgtccacggatttcgacagtaattcactgcgcaacgcggaaaacgagttcgctcgcattcagcaatcgatcaacctctggtcgttgcgcttgccttcggtgaagtcattgcgcgaactgatgctgccacacatgcgcgaacaactggatgaactggacgtcaaaaacccgagcgccatcagccgctttttcgatcgtgttggcagccatttcctgaccggcatcgtaatgggtggacgggccatcctcgcctcctcgaccaacaagctcagggtcaagcgtgactactcggtgtcggtggtcgccaaggcgagctacgaaggtctgaccggccagctgagcgcagaagcccgtaccaagtatggcgagtctatgagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 79 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtctgtgatcgccaaggcgagctacgaaggtctgaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagcgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 80 - DNA, 1449 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcatcctacaccaacatcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctgaaggtcaagcgtgactactcggtgtcggtggtcgccaaggcgagctacgaaggtctgaccggccagctgagcgcagaagcccgtaccaagtatggcgagtcgatcagcagcttcactcagtactccagcacccaccaggaagtgcgcggcggcgacggtaccaaggcacatggtgtgttcgaaggcaaagcaggtttccaggcctgggtagacagcgtgggcacctctccggacttcgtcgatttcgtccctaccatccctatgctggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagtctgtcccaactggctatatcaagctgcctcaggacctgaacaagggcgcgggcggtgctgatatctacctgtgctacaagctggagggttacaacaccgacaccgcaatcaacaagatcacggtcatcagcggcaacaatccggatatcaacgctccttatggttatctgaaggtccccggtgacctcaacagaggtgctggcggcaacttcatctatgcctgtaccttcgtaggcaag

SEQ ID NO: 81 - DNA, 1449 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggtctgggctataacccattcctgggttatgccggtgtcggcagcggcacggtgcaactgttcgactggaacaacgccaagaaaaaaaaagtgtctttcaaacctgaattcgtcgtacccgagatcgtcgacgtgcaacagaacgacagcgcatcctacaccaacatcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggtcgtgccatcctggccgcctctaccaacaagctgaaggtcaagcgtgactactctgtgtctgtgatcgccaaggcgagctacgaagggcttaccggccagttgagcgcagaagccaaagccaagtatggcgagtcgatcagcagcttcactcagtactccagcacccaccaggaagtgcgcggcggcgacggtaccaaggcacatggtgtgttcgaaggcaaagcaggtttccaggcctgggtagacagcgtgggcacctcgccggacttcgtcgatttcgtccccaccatccctatgctggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcggtagttcaaccatcgaaccaccggtcggctacaccaagatcccgtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgctgatatctacctgtgctacaagctggagggttacaacaccgacaccgcaatcaacaagatcacggtcatcagcggcaacaatccggatatcaacgctccttatggttatgagaaggtccctggtgacctgaacaaaggtgctaaaggcaacttcatctatgcctgtaccttcgtaggcaag

SEQ ID NO: 82 - DNA, 1452 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggtctgggctataacccattcctgggttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctgtcagcgtcgccatcgaaggcaaatacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggacgggccatcctggccgcctctaccaacaagctgaaggtcaagcgtgactactctgtgtctgtgatcgccaaggcgagctacgaaggtctgaccgaccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcgatagctctaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcatttacaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatccggatatcaacgctccttatggttatgagaaggtccctggtgacctgaacaaaggtgctggcggcaacttcatctatgcctgtaccttcgtaggcaag

SEQ ID NO: 83 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacgaaaattctctgcgcaacgcggaaaacgagttcactcgcattcagcaatctatcaacctgtggtctctgcgcctgccttctgtgaagtctctgcgcgacctgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtctgtgatcgccaaggcgagctacgaaggtctgaccggccagctgagcgcaaaagcccgtaccaagtatggcgagtctatgagcagcttcactcagtactccagcacccaccaggaagtgcgcggcggcgacggtgccaaggcacatggggtgttcagcggcaaaaaagaagatttccaggcctgggtagacagtgtgagcgcctctccggacttcgtcgatttcgtccctaccatccctatgcaggaaatctggaccctgtgcagcagcgaggcgcaggccgaggccatgcgcaagcattacgatgacgtctgggcgccggcgcaatcggaaaagtaccgtatcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 84 - DNA, 1449 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggtctgggctataacccattcctgggttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggcaaatacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctatttcgatagagttggcagccatttcctgaccggcatcgtaatgggtggtcgtgccatcctggccgcctctaccaacaagctgaaggtcaagcgtgactactctgtgtctgtgatcgccaaggcgagctacgaaggtctgaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagcgtgggcacctctccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacaccaagatcccgtacgacctgaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatatctacctgtgctacaagctggagggttacaacaccgacaccgcaatcaacaagatcacggtcatcagcggcaacaatccggatatcaacgctccctatggttatctgaaggtccccggtgacctcaacagaggtgctggcggcaacttcatctatgcctgtaccttcgtaggcaag

SEQ ID NO: 85 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaacctgaattcgtcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttccttaccggcatcgtaatgggtggtcgtgccatcctggccgcctctaccaacaagctgaaggtcaagcgtgactactctgtgtctgtgatcgccaaggcgagctacgaaggtctgaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcgatagctctaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccaactggctatatcaagctgcctcaggacctgaacaagggcgcgggcggtgctgatatctacctgtgctacaagctggagggttacaacaccgacaccgcaatcaacaagatcacggtcatcagcggcaacaatccggatatcaacgctccttatggttatgagaaggtccctggtgacctcaacagaggtgctggcggcaacttcatctatgcctgtaccttcgtaggcaag

SEQ ID NO: 86 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctgtggtctctgcgcctgccttctgtgaagtctctgcgcgacctgatgctgccacacatgcgcgaacaactggatgaactggacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaaggtctgaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagcgtgggcacctctccggacttcgtcgatttcgtccctaccatccctatgctggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 87 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggtcgtgccatcctggccgcctctaccaacaagctgaaggtcaagcgtgactactctgtgtctgtgatcgccaaggcgagctacgaaggtctgaccggccagctgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggccggctacaccaagatcgagtacgacctcaatgccggtgccggcggtgacttcatctacttgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 88 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactctgtgtctgtgatcgccaaggcgagctacgaaggtctgaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagcgtgggcacctctccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 89 - DNA, 1449 bp, Artificial Sequence
  IPD090 variant
atggaaaacatagacttgccacaaggacttgtaaacttttccacgcaacacctgcaacttattctttttatagcatgtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 90 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactggaacaacgccaagaaaaaaaaagtgtctttcaaacctgaattcgtcgtacctgagatcgtcgacgtgcaacagaacgacagcgcaacctacaccaacgtcagcggcaacacggtcaccgagtaccagcgcagtctggctaccagcgtcgccatcgaaggccgttacaacttcttcagtggctcgctgtccacggattacgacgaaaattctctgcgcaacgcggaaaacgagttcactcgcattcagcaatcgatcaacctctggtcgttgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggtcgtgccatcctggccgcctctaccaacaagctgaaggtcaagcgtgactactctgtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccctatgctggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 91 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggtctgggctataacccattcctgggttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgccaacaactagatgaattgaacgtcaacgacccgaaggccataagccgctatttcgatagagttggcagccatttccttaccggcatcgtaatgggtggtcgtgccatcctggccgcctctaccaacaagctcagggtcaagcgtgactactcggtgtctgtgatcgccaaggcgagctacgaaggtctgaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagcgtgggcacctctccggacttcgtcgatttcgtccctaccatccctatgctggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgtcggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccttatggttatgagaaggtccctggtgacctgaacaaaggtgctaaaggcaacttcatctatgcctgtaccttcgtaggcaag

SEQ ID NO: 92 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacggtcagcgagtaccagcgcagtctggctaccagcgtcgccatcgaaggccgttacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttccttaccggcatcgtaatgggtggacgggccatcctcgcctcctcgaccaacaagctcagggtcaagcgtgactactcggtgtcggtggtcgccaaggcgagctacgaaggtctgaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaagatcacggtcatcagcggcaacaatccggatatcaacgctccttatggttatctgaaggtccccggtgacctcaacagaggtgctaaaggcaacttcatctatgcctgtaccttcgtaggcaag

SEQ ID NO: 93 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcatcctacaccaacgtcagcggcaacacgatcagcgagtaccagcgcagtctggctaccagcgtcgccatcgaaggccgttacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggtcgtgccatcctggccgcctctaccaacaagctgaaggtcaagcgtgactactctgtgtctgtgatcgccaaggcgagctacgaagggcttaccggccagttgagcgcagaagccaaagccaagtatggcgagtcgatcagcagcttcactcagtactccaatacccaccaggaagtgcgcggcggcgacggtaccaaggcacatggtgtgttcgaaggcaaagcaggtttccaggcctgggtagacagcgtgggcacctctccggacttcgtcgatttcgtccctaccatccctatgctggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 94 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgcgaacaactggatgaactggacgtcaaaaacccgagcgccatcagccgctttttcgatcgtgttggcagccatttcctgaccggcatcgtaatgggtggtcgtgccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagaccgaggcttacaacaccgacaccgcaatcaacaaggtcacggtcatcggcggcaacaatgcggatatcaacgctccttatggttatgagaaggtccctggtgacctgaacaaaggtgctaaaggcaacttcatctatgcctgtaccttcgtaggcaag

SEQ ID NO: 95 - DNA, 1449 bp, Artificial Sequence
  IPD090 variant
atggaaaacatagacttgccacaaggacttgtaaacttttccacgcaacacccgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcgacaacacggtcaccgagtaccagcgcagcctggctgtcagcgtcgccatcgaaggcaaatacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggtcgtgccatcctggccgcctctaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccagcacccaccaggaagtgcgcggcggcgacggtaccaaggcacatggtgtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaaggtcacggtcatcagcggcaacaatgcggatatcaacgctccctatggttatctgaaggtccccggtgacctcaacagaggtgctggcggcaacttcatctatgcctgtaccttcgtaggcaag

SEQ ID NO: 96 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacggtcaccgagtaccagcgcagcctggctgtcagcgtcgccatcgaaggcaaatacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggtcgtgccatcctggccgcctctaccaacaagctgaaggtcaagcgtgactactctgtgtctgtgatcgccaaggcgagctacgaaggtctgaccggccagctgagcgcagaagcccgtaccaagtatggcgagtcgatcagcagcttcactcagtactccaatacccaccaggaagtgcgcggcggcgacggtgccaaggcacatggtgtgttcgaaggcaaagcaggtttccaggcctgggtagacagcgtgggcacctctccggacttcgtcgatttcgtccctaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacaaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaagatcacggtcatcagcggcaacaatccggatatcaacgctccttatggttatgagaaggtccctggtgacctgaacaaaggtgctaaaggcaacttcatctatgcctgtaccttcgtaggcaag

SEQ ID NO: 97 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggcaaatacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctgaaggtcaagcgtgactactctgtgtctgtgatcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatctgacaagtaccgtatcaaggctaactacatcgaccaactggtggtcatcaccggcggtagttcaaccatcgaaccaccggccggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctgaacaaaggtgctaaaggcaacttcatctatgcctgtaccttcgtaggcaag

SEQ ID NO: 98 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacggtcaccgagtaccagcgcagcctggctgtcagcgtcgccatcgaaggcaaatacaacttcttcagcggctctctgtccacggattacgacgaaaattctctgcgcaacgcggaaaacgagttcactcgcattcagcaatcgatcaacctctggtcgttgcgcttgccttcggtgaagtctctgcgcgacctgatgctgccacacatgcgccaacaactagatgaattgaacgtcaacgacccgaaggccataagccgctatttcgatagagttggcagccatttcctgaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagcgtgggcacctctccggacttcgtcgatttcgtccctaccatccctatgctggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaagatcacggtcatcagcggcaacaatgcggatatcaacgctccctatggttatctgaaggtccccggtgacctcaacagaggtgctggcggcaacttcatctatgcctgtaccttcgtaggcaag

SEQ ID NO: 99 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactctgtgtctgtgatcgccaaggcgagctacgaaggtctgaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagcgtgggcacctctccggacttcgtcgatttcgtccctaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcgatagctctaccatcgaaccaccggccggctacaccaagatcccgtacgacctgaatgccggtgccggcggtgacttcatctacctgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaagatcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 100 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacctgagatcgtcgacgtgcaacagaacgacagcgcatcctacaccaacgtcagcggcaacacgatcagcgagtaccagcgcagcctggctgtcagcgtcgccatcgaaggcaaatacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 101 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcaccgagtaccagcgcagcctggctgtcagcgtcgccatcgaaggccgttacaacttcttcagtggctcgctgtccacggatttcgacagtaattcactgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtaccaaggcacatggtgtgttcgaaggcaaagcaggtttccaggcctgggtagacagcgtgggcacctctccggacttcgtcgatttcgtccctaccatccctatgctggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccttatggttatgagaaggtccctggtgacctgaacaaaggtgctaaaggcaacttcatctatgcctgtaccttcgtaggcaag

SEQ ID NO: 102 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagtcgctttttcgatcgtgttggcagccatttcctgaccggcatcgtaatgggtggtcgtgccatcctggccgcctctaccaacaagctgaaggtcaagcgtgactactctgtgtctgtgatcgccaaggcgagctacgaaggtctgaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagcgtgggcacctctccggacttcgtcgatttcgtccctaccatccctatgctggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcgatagctctaccatcgaaccaccggccggctacaccaagatcccgtacgacctgaatgccagtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 103 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgcgaacaactagatgaattgaacgtcaacgacccgaaggccataagccgctatttcgatcgtgttggcagccatttccttaccggcatcgtaatgggtggacgggccatcctcgcctcctctaccaacaagctgaaggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcgatagctctaccatcgaaccaccggccggctacaccaagatcccgtacgacctgaatgccggtgccggcggtgacttcatctacttgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaagatcacggtcatcagcggcaacaatccggatatcaacgctccttatggttatgagaaggtccctggtgacctgaacaaaggtgctggcggcaacttcatctatgcctgtaccttcgtaggcaag

SEQ ID NO: 104 - DNA, 1452 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcatcctacaccaacatcagcggcaacacgatcagcgagtaccagcgcagcctggctgtcagcgtcgccatcgaaggcaaatacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggtcgtgccatcctggccgcctctaccaacaagctgaaggtcaagcgtgactactctgtgtctgtgatcgccaaggcgagctacgaaggtctgaccggccagctgagcgcagaagcccgtaccaagtatggcgagtctatgagcagcttcactcagtactccagcacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccctatgctggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaagatcacggtcatcagcggcaacaatccggatatcaacgctccttatggttatgagaaggtccctggtgacctgaacaaaggtgctaaaggcaacttcatctatgcctgtaccttcgtaggcaag

SEQ ID NO: 105 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatctatcaacctgtggtctctgcgcctgccttctgtgaagtctctgcgcgacctgatgctgccacacatgcgcgaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaagatcacggtcatcagcggcaacaatccggatatcaacgctccttatggttatgagaaggtccctggtgacctgaacaaaggtgctaaaggcaacttcatctatgcctgtaccttcgtaggcaag

SEQ ID NO: 106 - DNA, 1452 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggtctgggctataacccattcctgggttatgccggtgtcggcagcggcacggtgcaactgttcgactggaacaacgccaagaaaaaaaaagtgtctttcaaacctgaattcgtcgtacctgagatcgtcgacgtgcaacagaacgacagcgcatcctacaccaacatcagcggcaacacggtcaccgagtaccagcgcagcctggctgtcagcgtcgccatcgaaggcaaatacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccctaccatccctatgctggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaagatcatggtcatcagcggcaacaatccggatatcaacgctccttatggttatgagaaggtccctggtgacctgaacagaggtgctggcggcaacttcatctatgcctgtaccttcgtaggcaag

SEQ ID NO: 107 - DNA, 1452 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggtctgggctataacccattcctgggttatgccggtgtcggcagcggcacggtgcaactgttcgactggaacaacgccaagaaaaaaaaagtgtctttcaaacctgaattcgtcgtacctgagatcgtcgacgtgcaacagaacgacagcgcatcctacaccaacatcagcggcaacacggtcaccgagtaccagcgcagcctggctgtcagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctgaaggtcaagcgtgactactctgtgtctgtgatcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaagatcacggtcatcagcggcaacaatccggatatcaacgctccctatggttatctgaaggtccccggtgacctcaacagaggtgctggcggcaacttcatctatgcctgtaccttcgtaggcaag

SEQ ID NO: 108 - DNA, 1446 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacctgagatcgtcgacgtgcaacagaacgacagcgcatcctacaccaacatcagcggcaacacggtcaccgagtaccagcgcagcctggctgtcagcgtcgccatcgaaggcaaatacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttccttaccggcatcgtaatgggtggacgggccatcctcgcctcctcgaccaacaagctcagggtcaagcgtgactactcggtgtcggtggtcgccaaggcgagctacgaaggtctgaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagcgtgggcacctctccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcgatagttcaaccatcgaaccaccggtcggctacagcaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 109 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggattacgacgaaaattctctgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaaggtctgaccggccagctgagcgcagaagcccgtaccaagtatggcgagtctatgagcagcttcactcagtactccagcacccaccaggaagtgcgcggcggcgacggtgccaaggcacatggggtgttcagcggcaaaaaagaagatttccaggcctgggtagacagcgtgggcacctctccggacttcgtcgatttcgtccctaccatccctatgctggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcgatagctctaccatcgaaccaccggccggctacaccaagatcccgtacgacctgaatgccggtgccggcggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaagatcacggtcatcagcggcaacaatccggatatcaacgctccttatggttatgagaaggtccctggtgacctgaacaaaggtgctaaaggcaacttcatctatgcctgtaccttcgtaggcaag

SEQ ID NO: 110 - DNA, 1449 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggtctgggctataacccattcctgggttatgccggtgtcggcagcggcacggtgcaactgttcgactggaacaacgccaagaaaaaaaaagtgtctttcaaacctgaattcgtcgtacctgagatcgtcgacgtgcaacagaacgacagcgcaacctacaccaacatcagcggcaacacggtcaccgagtaccagcgcagcctggctgtcagcgtcgccatcgaaggccgttacaacttcttcagcggctctctgtccacggattacgacgaaaattctctgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttcctgaccggcatcgtaatgggtggtcgtgccatcctggccgcctctaccaacaagctgaaggtcaagcgtgactactctgtgtctgtgatcgccaaggcgagctacgaaggtctgaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagcgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 111 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggtcgtgccatcctggccgcctctaccaacaagctgaaggtcaagcgtgactactctgtgtctgtgatcgccaaggcgagctacgaaggtctgaccggccagttgagcgcagaagccaaagccaagtatggcgagtcgatcagcagcttcactcagtactccagcacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccgacgcaatcggaaaagtaccgggtcaaggctaactacatcgaccaactggtggtcatcaccggcggtagttcaaccatcgaaccaccggtcggctacagcaagatcgagtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaagatcacggtcatcagcggcaacaatccggatatcaacgctccttatggttatgagaaggtccctggtgacctgaacaaaggtgctaaaggcaacttcatctatgcctgtaccttcgtaggcaag

SEQ ID NO: 112 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcatcctacaccaacatcagcggcaacacggtcaccgagtaccagcgcagcctggctgtcagcgtcgccatcgaaggcaaatacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggtcgtgccatcctggccgcctctaccaacaagctgaaggtcaagcgtgactactctgtgtctgtgatcgccaaggcgagctacgaaggtctgaccgggcagctgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggccggctacaccaagatcccgtacgacctgaatgccggtgccaaaggtgacttcatctacctgtgctatcacgaacaaacctggcaggccgacaggcctaaagatgttgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 113 - DNA, 1449 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggtctgggctataacccattcctgggttatgccggtgtcggcagcggcacggtgcaactgttcgactggaacaacgccaagaaaaaaaaagtgtctttcaaacctgaattcgtcgtacctgagatcgtcgacgtgcaacagaacgacagcgcatcctacaccaacatcagcggcaacacggtcaccgagtaccagcgcagcctggctgtcagcgtcgccatcgaaggcaaatacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggtcgtgccatcctggccgcctctaccaacaagctgaaggtcaagcgtgactactcggtgtcggtggtcgccaaggcgagctacgaaggtctgaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagtgtgagcgcctcgccggacttcgtcgatttcgtccccaccatccccatgcaggaaatctggaccctgtgcaaaaccgactctcaggccgaggccatgcgcaagcattacgatgacgtctgggcgcgtgagcaatctgacaagtaccgtatcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 114 - protein, 484 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTVTEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPDDLNRGAGGNFIYACTFVGK

SEQ ID NO: 115 - protein, 483 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTVTEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKLDYSVSVIAKASYEGLTGQLSAEARTKYGESMSSFTHYSSTHQEVRGGDGTKAHGVFEGKAGFQAWVDSVGTSPDFVDFVPTIPMLEIWSLCKTDSQAEAMKRHFDTVWAREQSDKYRIKANYIDQLVVITGDSSTIEPPAGYTKIPYDLNAGAKGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 116 - protein, 484 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTFTEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEARNKYGESMSSFTQYSSTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 117 - protein, 483 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTVTEYQRSLAVSVAIEGKYNFFSGSLSTDYDENSLRNAENEFTRIQQSINLWSLRLPSVKSLRELMLPHMREQLDELDVKNPSAISRFFDRVGSHFLTGIVMGGRAILAASTNKLRVKRDYSVSVIAKASYEGLTGQLSAEAKAKYGESMSSFTQYSSTHQEVRGGDGTKAHGVFEGKAGFQAWVDSVGTSPDFVDFVPTIPMLEIWSLCKTDSQAEAMKRHFDTVWAREQSDKYRIKANYIDQLVVITGDSSTIEPPAGYTKIPYDLNAGAKGDFIYLCYHEQAWYPDNTKPAVTAIKIIYDREPVPTGYIKLPQDLNKGAGGADIYLCYKLEGYNTDTAINKITVISGNNPDINAPYGYEKVPGDLNKGAKGNFIYACTFVGK

SEQ ID NO: 118 - protein, 483 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTVTEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEARTKYGESMSSFTQYSSTHQEVRGGDGTKAHGVFEGKAGFQAWVDSVGTSPDFVDFVPTIPMLEIWSLCKTDSQAEAMKRHFDTVWASEQSDKYRIKANYIDQLVVITGDSSTIEPPAGYTKIPYDLNAGAKGDFIYLCYHEQAWYPDNTKPAVTAIKIIYDREPVPTGYIKLPQDLNKGAGGDDVFLCYKTEAYNTDTAINKVTVIGGNNADINAPYGYLKVPGDLNRGAGGNFIYACTFVGK

SEQ ID NO: 119 - protein, 484 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTVTEYQRSLAVSVAIEGKYNFFSGSLSTDYYENSLRNAENEFTRIQQSINLWSLRLPSVKSLRDLMLPHMREQLDELDVKNPSAISRFFDRVGSHFLTGIVMGGRAIIASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCKTDSQAEAMKRHFDTVWAREQSDKYRIKANYIDQLVVITGDSSTIEPPAGYTKIPYDLNAGAKGDFIYLCYHEQAWYPDNTKPAVTAIKIIYDREPVPTGYIKLPQDLNKGAGGADIYLCYKLEGYNTDTAINKITVISGNNPDINAPYGYEKVPGDLNKGAKGNFIYACTFVGK

SEQ ID NO: 120 - protein, 483 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTVTEYQRSLAVSVAIEGKYNFFSGSLSTDYDENSLSNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEARTKYGESMSSFTQYSSTHQEVRGGDGTKAHGVFEGKAGFQAWVDSVGTSPDFVDFVPTIPMLEIWSLCKTDSQAEAMKRHFDTVWAREQSDKYRIKANYIDQLVVITGDSSTIEPPVGYSKIEYDLNAGAKGDFIYLCYHEQAWYPDNTKPAVTEIKIIYDREPVPTGYIKLPQDLNKGAGGADIYLCYKLEGYNTDTAINKITVISGNNPDINAPYGYEKVPGDLNKGAKGNFIYACTFVGK

SEQ ID NO: 121 - protein, 483 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTVTEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVVAKASYEGLTGQLSAEARTKYGESMSSFTQYSSTHQEVRGGDGTKAHGVFEGKAGFQAWVDSVGTSPDFVDFVPTIPMLEIWSLCKTDSQAEAMKRHFDTVWAREQSDKYRVKANYIDQLVVITGGSSTIEPPVGYSKIEYDLNAGAKGDFIYLCYHEQAWYPDNTKPAVTAIKIIYDREPVPTGYIKLPQDLNKGAGGADIYLCYKLEGYNTDTAINKVTVIGGNNADINAPYGYLKVPGDLNRGAGGNFIYACTFVGK

SEQ ID NO: 122 - protein, 484 aa, Artificial Sequence
  IPD090 variant
MEHVDLPTGLVKFSSNHHLQLLRDTADLSESVLPGVEAIGLGYNQFLGYAGVGSGTVQLFDWNNAKKKKVSFKPEFVVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 123 - protein, 484 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTVTEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEARTKYGESMSSFTQYSSTHQEVRGGDGAKAHGVFSGKKEDFQAWVDSVSASPDFVDFVPTIPMLEIWSLCKTDSQAEAMKRHFDTVWAREQSDKYRIKANYIDQLVVITGDSSTIEPPAGYTKIPYDLNAGAKGDFIYLCYHEQAWYPDNTKPAVTAIKIIYDREPVPTGYIKLPQDLNKGAGGADIYLCYKLEGYNTDTAINKITVIRGNNPDINAPYGYEKVPGDLNKGAKGNFIYACTFVGK

SEQ ID NO: 124 - protein, 483 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPELVVPEIVDVQQNDSASYTNISGNTVTEYQRSLAVSVAIEGRYNFFSGSLSTDFDSNSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEARTKYGESMSSFTQYSSTHQEVRGGDGTKAHGVFEGKAGFQAWVDSVGTSPDFVDFVPTIPMLEIWSLCKTDSQAEAMKRHFDTVWAREQSDKYRIKANYIDQLVVITGDSSTIEPPAGYTKIPYDLNAGAKGDFIYLCYHEQAWYPDNTKPAVTAIKIIYDREPVPTGYIKLPQDLNKGAGGADIYLCYKLEGYNTDTAINKITVISGNNPDINAPYGYEKVPGDLNKGAKGNFIYACTFVGK

SEQ ID NO: 125 - protein, 483 aa, Artificial Sequence
  IPD090 variant
MEHVDLPQGLVNFSTQHLQLIRFKAGLNETVLPGVEAIGLGYNPFISYASVNSGAVQLFDWATAKKREVPFRAGYFVPEIVDVQQNDSATYTNVSGNTISEYQRSLATSVAIEGRYNFFSGSLSTDYDENSLRNAENEFTRIQQSINLWSLRLPSVKSLRDLMLPHMREQLDELDVKNPSAISRFFDRVGSHFLTGIVMGGRAILAASTNKLRVKRDYSVSVVAKASYEGLTGQLSAEAKAKYGESISSFTQYSNTHQEVRGGDGAKAHGVFSGKKEDFQAWVDSVGASPDFVDFVPTIPMLEIWSLCKTDSQAEAMKRHFDTVWAREQSDKYRIKANYIDQLVVITGDSSTIEPPAGYTKIPYDLNAGAGGDFIYLCYHEQTWQADRPKDAVTDIRIIFNKEPTPPGYTKLPQDLNKGAGGDDVFLCYKTEAYNTDTAINKITVISGNNPDINAPYGYEKVPGDLNKGAKGNFIYACTFVGK

SEQ ID NO: 126 - protein, 484 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSATYTNISGNTVTEYQRSLAVSVAIEGKYNFFSGSLSTDYDENSLRNAENEFTRIQQSINLWSLRLPSVKSLRELMLPHMRQQLDELNVNDPKAISRYFDRVGSHFLTGIVMGGRAILAASTNKLRVKRDYSVSVVAKASYEGLTGQLSAEARTKYGESMSSFTQYSNTHQEVRGGDGAKAHGVFSGKKEDFQAWVDSVSTSPDFVDFVPTIPMLEIWSLCKTDSQAEAMKRHFDTVWAREQSDKYRIKANYIDQLVVITGDSSTIEPPAGYTKIPYDLNAGAKGDFIYLCYHEQAWYPDNTKPAVTAIKIIYDREPVPTGYIKLPQDLNKGAGGADIYLCYKLEGYNTDTAINKVTVIGGNNADINAPYGYLKVPGDLNRGAGGNFIYACTFVGK

SEQ ID NO: 127 - protein, 483 aa, Artificial Sequence
  IPD090 variant
MENVDLPTGLVKFSSNHHLQLLRDTADLSESVLPGVEAIGLGYNPFLGYAGVGSGTVQLFDWNNAKKKKVSFKPEFVVPEIVDVQQNDSATYTNISGNTVTEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILASSTNKLKVKRDYSVSVIAKASYEGLTGQLSAEARTKYGESMSSFTQYSSTHQEVRGGDGTKAHGVFEGKAGFQAWVDSVGTSPDFVDFVPTIPMQEIWTLCSSEAQAEAMRKHYDDVWAPAQSEKYRVKANYIDQLVVITGDSSTIEPPAGYTKIPYDLNAGAKGDFIYLCYNEQAWYPDNTKPAVTAIKIIYDREPVPTGYIKLPQDLNKGAGGADIYLCYKLEGYNTDTAINKVTVIGGNNADINAPYGYLKVPGDLNRGAGGNFIYACTFVGK

SEQ ID NO: 128 - protein, 484 aa, Artificial Sequence
  IPD090 variant
MEHIDLPTGLVKFSSNHHLQLLRDTADLSESVLPGVEAIGLGYNPFLGYAGVGSGTVQLFDWNNAKKKKVSFKPEFVVPEIVDVQQNDSASYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLKVKRDYSVSVIAKASYEGLTGQLSAEARTKYGESISSFTQYSNTHQEVRGGDGAKAHGVFSGKKEDFQAWVDSVGASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 129 - protein, 482 aa, Artificial Sequence
  IPD090 variant
MEHVDLPQGLVNFSTQHLQLIRFKAGLNETVLPGVEAIGLGYNPFISYASVNSGAVQLFDWATAKKREVPFKAGYFVPEIVDVQQNDSASYTNVSGNTISEYQRSLATSVAIEGRYNFFSGSLSTDFDSNSLRNAENEFTRIQQSINLWSLRLPSVKSLRDLMLPHMREQLDELDVKNPSAISRFFDRVGSHFLTGIVMGGRAILASSTNKLKVKRDYSVSVIAKASYEGLTGQLSAEARTKYGESMSSFTQYSSTHQEVRGGDGTKAHGVFEGKAGFQAWVDSVGTSPDFVDFVPTIPMLEIWSLCKTDSQAEAMKRHFDTVWAREQSDKYRIKANYIDQLVVITGDSSTIEPPAGYTKIPYDLNAGAKGDFIYLCYHEQAWYPDNTKPAVTAIKIIYDREPVPTGYIKLPQDLNKGAGGADIYLCYKTEAYNTDTAINKVTVIGGNNADINAPYGYLKVPGDLNRGAGGNFIYACTFVGK

SEQ ID NO: 130 - protein, 483 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSATYTNISGNTVTEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILASSTNKLKVKRDYSVSVIAKASYEGLTGQLSAEARTKYGESMSSFTQYSSTHQEVRGGDGTKAHGVFEGKAGFQAWVDSVSTSPDFVDFVPTIPMQEIWTLCSSEAQAEAMRKHYDDVWAREQSDKYRIKANYIDQLVVITGDSSTIEPPVGYSKIEYDLNAGAKGDFIYLCYHEQAWYPDNTKPAVTAIKIIYDREPVPTGYIKLPQDLNKGAGGADIYLCYKLEGYNTDTAINKVTVIGGNNADINAPYGYLKVPGDLNRGAGGNFIYACTFVGK

SEQ ID NO: 131 - protein, 483 aa, Artificial Sequence
  IPD090 variant
MENVDLPQGLVNFSTQHLQLIRFKAGLNETVLPGVEAIGLGYNPIISYASVNSGAVQLFDWATAKKREVPFKPEFVVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILAASTNKLNVKRDYSVSVVAKASYEGLTGQLSAEAKAKYGESISSFTQYSNTHQEVRGGDGAKAHGVFSGKKEDFQAWVDSVGASPDFVDFVPTIPMLEIWSLCKTDSQAEAMKRHFDTVWAREQSDKYRIKANYIDQLVVITGDSSTIEPPAGYTKIPYDLNAGAKGDFIYLCYHEQAWYPDNTKPAVTAIKIIYDREPVPTGYIKLPQDLNKGAGGADIYLCYKLEGYNTDTAINKITVISGNNPDINAPYGYEKVPGDLNKGAKGNFIYACTFVGK

SEQ ID NO: 132 - protein, 483 aa, Artificial Sequence
  IPD090 variant
MEHVDLPQGLVNFSTQHLQLIRFKAGLNETVLPGVEAIGLGYNPFISYASVNSGAVQLFDWATAKKREVPFKAGYFVPEIVDVQQNDSASYTNVSGNTISEYQRSLATSVAIEGRYNFFSGSLSTDFDSNSLRNAENEFTRIQQSINLWSLRLPSVKSLRDLMLPHMREQLDELDVKNPSAISRFFDRVGSHFLTGIVMGGRAILAASTNKLKVKRDYSVSVVAKASYEGLTGQLSAEARTKYGESMSSFTQYSSTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 133 - protein, 482 aa, Artificial Sequence
  IPD090 variant
MEHVDLPQGLVNFSTQHLQLIRLKAGLNETVLPGVEAIGLGYNPFISYASVNSGAVQLFDWATAKKREVPFKAGYFVPEIVDVQQNDSATYTNISGNTVTEYQRSLAVSVAIEGKYNFFSGSLSTDYDENSLRNAENEFTRIQQSINLWSLRLPSVKSLRELMLPHMRQQLDELNVNDPKAISRYFDRVGSHFLTGIVMGGRAILASSTNKLKVKRDYSVSVIAKASYEGLTGQLSAEARTKYGESMSSFTQYSSTHQEVRGGDGTKAHGVFEGKAGFQAWVDSVSASPDFVDFVPTIPMQEIWTLCSCEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKITVISGNNPDINAPYGYEKVPGDLNKGAKGNFIYACTFVGK

SEQ ID NO: 134 - protein, 483 aa, Artificial Sequence
  IPD090 variant
MENIDLPTGLVKFSSNHHLQLLRDTADLSESVLPGVEAIGLGYNPFLGYAGVGSGTVQLFDWNNAKKKKVSFKPEFVVPEIVDVQQNDSATYTNVSGNTISEYQRSLATSVAIEGRYNFFSGSLSTDFDSNSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEARTKYGESMSSFTQYSRTHQEVRGGDGTKAHGVFEGKAGFQAWVDSVSASPDFVDFVPTIPMLEIWSLCKTDSQAEAMKRHFDTVWAREQSDKYRIKANYIDQLVVITGDSSTIEPPAGYTKIPYDLNAGAGGDFIYLCYHEQAWYPDNTKPAVTAIKIIYDREPVPTGYIKLPQDLNKGAGGADIYLCYKLEGYNTDTAINKVTVIGGNNADINAPYGYLKVPGDLNRGAGGNFIYACTFVGK

SEQ ID NO: 135 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEARTKYGESMSSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGDSSTIEPPAGYTKIPYDLNAGAKGDFIYLCYHEQAWYPDNTKPAVTDIRIIFNKEPTPPGYTKLPQDLNKGAGGDDVFLCYKTEAYNTDTAINKVTVIGGNNADINAPYGYEKVPGDLNRGAGGNFIYACTFVGK

SEQ ID NO: 136 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSASYTNISGNTVTEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMLEIWSLCKTDSQAEAMKRHFDTVWAREQSDKYRIKANYIDQLVVITGGSSTIEPPVGYTKIPYDLNAGAKGDFIYLCYHEQAWYPDNTKPAVTAIKIIYDREPVPTGYTKLPQDLNKGAGGDDVFLCYKTEAYNTDTAINKVTVIGGNNADINAPYGYLKVPGDLNRGAGGNFIYACTFVGK

SEQ ID NO: 137 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSASYTNISGNTVTEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILASSTNKLRVKRDYSVSVVAKASYEGLTGQLSAEARTKYGESMSSFTQYSSTHQEVRGGDGTKAHGVFEGKAGFQAWVDSVGTSPDFVDFVPTIPMQEIWTLCKTDSQAEAMKRHFDTVWAREQSDKYRIKANYIDQLVVITGDSSTIEPPAGYTKIEYDLNAGAKGDFIYLCYHEQAWYPDNTKPAVTAIKIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 138 - protein, 484 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTVTEYQRSLAVSVAIEGKYNFFSGSLSTDYDENSLRNAENEFTRIQQSINLWSLRLPSVKSLRELMLPHMRQQLDELNVNDPKAISRYFDRVGSHFLTGIVMGGRAILAASTNKLRVKRDYSVSVVAKASYEGLTGQLSAEARTKYGESMSSFTQYSSTHQEVRGGDGAKAHGVFSGKKEDFQAWVDSVGTSSDFVDFVPTIPMLKIWSLCKTDSQAEAMKRHFDTVWAREQSDKYRIKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 139 - protein, 483 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEARTKYGESMSSFTQYSSTHQEVRGGDGTKAHGVFEGKAGFQAWVDSVGTSPDFVDFVPTIPMLEIWSLCKTDSQAEAMKRHFDTVWAREQSDKYRIKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNKGAKGNFIYACTFVGK

SEQ ID NO: 140 - protein, 482 aa, Artificial Sequence
  IPD090 variant
MENIDLPQGLVNFSTQHLQLIRFKAGLNETVLPGVEAIGLGYNPFISYASVNSGTVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRDLMLPHMREQLDELDVKNPSAISRFFDRVGSHFLTGIVMGGRAILASSTNKLRVKRDYSVSVVAKASYEGLTGQLSAEARTKYGESMSSFTQYSSTHQEVRGGDGTKAHGVFEGKAGFQAWVDSVGTSPDFVDFVPTIPMLEIWSLCKTDSQAEAMKRHFDTVWAREQSDKYRIKANYIDQLVVITGDSSTIEPPAGYTKIPYDLNAGAGGDFIYLCYHEQTWQADRPKDAVTDIKIIYDREPVPTGYIKLPQDLNKGAGGADIYLCYKLEGYNTDTAINKVTVIGGNNADINAPYGYLKVPGDLNRGAGGNFIYACTFVGK

SEQ ID NO: 141 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRDLMLPHMREQLDELDVKNPSAISRFFDRVGSHFLTGIVMGGRAILASSTNKLRVKRDYSVSVIAKASYEGLTGQLSAEARTKYGESMSSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQAWYPDNTKPAVTAIKIIYDREPVPTGYIKLPQDLNKGAGGADIYLCYKLEGYNTDTAINKVTVIGGNNPDINAPYGYEKVPGDLNKGAKGNFIYACTFVGK

SEQ ID NO: 142 - protein, 484 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTVTEYQRSLAVSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILAASTNKLKVKRDYSVSVIAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYIKLPQDLNKGAGGDDVFLCYKTEAYNTDTAINKVTVIGGNNPDINAPYGYLKVPGDLNRGAGGNFIYACTFVGK

SEQ ID NO: 143 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVSFKPEFVVPEIVDVQQNDSASYTNISGNTVTEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSSTHQEVRGGDGTKAHGVFEGKAGFQAWVDSVGTSPDFVDFVPTIPMLEIWSLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 144 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSASYTNISGNTVTEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEARTKYGESMSSFTQYSSTHQEVRGGDGTKAHGVFEGKAGFQAWVDSVGTSPDFVDFVPTIPMLEIWSLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 145 - protein, 482 aa, Artificial Sequence
  IPD090 variant
  misc_feature (278)..(278): Xaa can be any naturally occurring amino acid
  misc_feature (288)..(288): Xaa can be any naturally occurring amino acid
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDENSLRNAENEFTRIQQSINLWSLRLPSVKSLRDLMLPHMRQQLDELNVNDPKAISRYFDRVGSHFLTGIVMGGRAILASSTNKLRVKRDYSVSVVAKASYEGLTGQLSAEAKAKYGESMSSFTQYSSTHQEVRGGDGTKAHGVFEGKAGXQAWVDSVGTXPDFVDFVPTIPMQEIWSLCKTDSQAEAMKRHFDTVWAREQSDKYRIKANYIDQLVVITGDSSTIEPPVGYSKIEYDLNAGAGGDFIYLCYHEQTWQADRPKDAVTDIRIIFNKEPTPPGYTKLPQDLNKGAGGADIYLCFKLEGYNTDTAINKITVISGNNPDINAPYGYEKVPGDLNKGDKGNFIYACTFVGK

SEQ ID NO: 146 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRDLMLPHMREQLDELDVKNPSAISRFFDRVGSHFLTGIVMGGRAILAASTNKLKVKRDYSVSVVAKASYEGLTGQLSAETRTKYGESMSSFTQYSNTHQEVRGGDGAKAHGVFSGKKEDFQAWVDSVSASPDFVDFVPTIPMLEIWSLCKTDSQAEAMKRHFDTVWAREQSDKYRIKANYIDQLVVITGGSSTIEPPVGYSKIEYDLNAGAGGDFIYLCYHEQTWQADRPKDAVTDIRIIFNKEPTPPGYTKLPQDLNKGAGGDDIYLCYKLEGYNTDTAINKVTVIGGNNADINAPYGYLKVPGDLNRGAGGNFIYACTFVGK

SEQ ID NO: 147 - protein, 483 aa, Artificial Sequence
  IPD090 variant
MENIDLPQGLVNFSKQHLQLIRFKAGLNETVLPGVEAIGLGYNPFISYASVNSGAVQLFDWATAKKREVPFKAGYFVPEIVDVQQNDSASYTNISGNTVTEYQRSLATSVAIEGRYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVVAKASYEGLTGQLSAEAKAKYGESISSFTQYSSTHQEVRGGDGTKAHGVFSGKKEDFQAWVDSVSASPDFVDFVPTIPMQEIWTLCSSEAQAEAMRKHYDDVWAPAQSEKYRVKANYIDQLVVITGDSSTIEPPAGYTKIPYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 148 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNISGNTISEYQRSLATSVAIEGRYNFFSGSLSTDYDENSLRNAENEFTRIQQSINLWSLRLPSVKSLRDLMLPHMREQLDELDVKNPKAISRYFDRVGSHFLTGIVMGGRAILAASTNKLKVKRDYSVSVIAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGDSSTIEPPAGYSKIEYDLNAGAGGDFIYLCYHEQTWQADRPKDAVTDIRIIFNKEPTPPGYTKLPQDLNKGAGGDDVFLCYKTEAYNTDTAINKITVISGNNPDINAPYGYLKVPGDLNKGAKGNFIYACTFVGK

SEQ ID NO: 149 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMKRHFDTVWAREQSDKYRIKANYIDQLVVITGDSSTIEPPAGYTKIPYDLNAGAKGDFIYLCYHEQAWYPDNTKPAVTAIKIIYDREPVPPGYTKLPQDLNKGAGGDDVFLCYKTEAYNTDTAINKVTVIGGNNADINAPYGYLKVPGDLNRGAGGNFIYACTFVGK

SEQ ID NO: 150 - protein, 484 aa, Artificial Sequence
  IPD090 variant
MEHVDLPTGLVKFSSNHHLQLLRDTADLSESVLPGVEAIGLGYNPFLGYAGVGSGTVQLFDWATAKKREVPFKAGYFVPEIVDVQQNDSASYTNISGNTVTEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVIAKASYEGLTGQLSAEARTKYGESMSSFTQYSNTHQEVRGGDGTKAHGVFSGKKEDFQAWVDSVSASPDFVDFVPTIPMLEIWSLCSSEAQAEAMRKHYDDVWAPAQSEKYRVKANYIDQLVVITGDSSTIEPPAGYTKIPYDLNAGAKGDFIYLCYHEQAWYPDNTKPAVMAIKIIYDREPVPTGYIKLPQDLNKGAGGDDVFLCYKTEAYNTDTAINKVTVIGGNNADINAPYGYLKVPGDLNRGAGGNFIYACTFVGK

SEQ ID NO: 151 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSASYTNISGNTISEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEARTKYGESMSSFTQYSSTHQEVRGGDGTKAHGVFEGKAGFQAWVDSVGTSPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQAWYPDNTKPAVTAIKIIYDREPVPTGYIKLPQDLNKGAGGADIYLCYKLEGYNTDTAINKITVISGNNPDINAPYGYEKVPGDLNKGAKGNFIYACTFVGK

SEQ ID NO: 152 - protein, 483 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNVSGNTVTEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEARTKYGESMSSFTQYSSTHQEVRGGDGTKAHGVFEGKAGFQAWVDSVSASPDFVDFVPTIPMLEIWSLCKTDSQAEAMKRHFDTVWAREQSDKYRIKANYIDQLVVITGDSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 153 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSASYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVGTSPDFVDFVPTIPMQEIWTLCSSEAQAEAMRKHYDDVWAPAQSEKYRVKANYIDQLVVITGGSSTIEPPAGYTKIPYDLNAGAKGDFIYLCYHEQAWYPDNTKPAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 154 - protein, 483 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTVTEYQRSLATSVAIEGRYNFFSGSLSTDYDENSLRNAENEFTRIQQSINLWSLRLPSVKSLRDLMLPHMREQLDELDVKNPSAISRFFDRVGSHFLTGIVMGGRAILAASTNKLRVKRDYSVSVVAKASYEGLTGQLSAEAKAKYGESISSFTQYSNTHQEVRGGDGTKAHGVFEGKAGFQAWVDSVGTSPDFVDFVPTIPMQEIWTLCSSEAQAEAMRKHYDDVWAPAQSEKYRVKANYIDQLVVITGDSSTIEPPAGYTKIPYDLNAGAKGDFIYLCYHEQAWYPDNTKPAVTAIKIIYDREPVPTGYTKLPQDLNKGAGGDDVFLCYKTEAYNTDTAINKITVIGGNNADINAPYGYLKVPGDLNRGAGGNFIYACTFVGK

SEQ ID NO: 155 - protein, 483 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTVTEYQRSLAVSVAIEGRYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEAKAKYGESISSFTQYSSTHQEVRGGDGTKAHGVFEGKAGFQAWVDSVGTSPDFVDFVPTIPMLEIWTLCSSEAQAEAMRKHYDDVWAPAQSEKYRVKANYIDQLVVITGGSSTIEPPVGYSKIEYDLNAGAKGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 156 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILTASTNKLKVKRDYSVSVVAKASYEGLTGQLSAEAKAKYGESISSFTQYSSTHQEVRGGDGTKAHGVFSGKKEDFQAWVDSVGTSPDFVDFVPTIPMQEIWSLCKTDSQAEAMKRHFDTVWAREQSDKYRIKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 157 - protein, 484 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTVTEYQRSLAVSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMLEIWTLCKTDSQAEAMKRHFDTVWAPAQSEKYRVKANYIDQLVVITGGSSTIEPPVGYTKIPYDLNAGAKGDFIYLCYHEQAWYPDNTKPAVTAIKIIYDREPVPTGYIKLPQDLNKGAGGADIYLCYKLEGYNTDTAINKITVIGGNNADINAPYGYLKVPGDLNRGAGGNFIYACTFVGK

SEQ ID NO: 158 - protein, 484 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSATYTNVSGNTISEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILAASTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCKTDSQAEAMKRHFDTVWAREQSDKYRIKANYIDQLVVITGGSSTIEPPVGYSKIEYDLNAGAGGDFIYLCYHEQAWYPDNTKPAVTDIRIIFNKEPTPPGYTKLPQDLNKGAGGDDVFLCYKTEAYNTDTAINKVTVIGGNNPDINAPYGYLKVPGDLNRGAGGNFIYACTFVGK

SEQ ID NO: 159 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDYDENSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFEGKAGFQAWVDSVGTSPDFVDFVPTIPMLEIWSLCKTDSQAEAMKRHFDTVWAREQSDKYRIKANYIDQLVVITGDSSTIEPPAGYTKIPYDLNAGAKGDFIYLCYHEQAWYPDNTKPAVTAIKIIYDREPVPTGYIKLPQDLNKGAGGDDVFLCYKLEGYNTDTAINKITVIGGNNADINAPYGYEKVPGDLNRGAGGNFIYACTFVDK

SEQ ID NO: 160 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVIAKASYEGLTGQLSAEARTKYGESMSSFTQYSSTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGDSSTIEPPVGYSKIEYDLNAGAGGDFIYLCYHEQTWQADRPKDAVTDIRIIFNKEPTPPGYTKLPQDLNKGAGGADIYLCYKLEGYNTDTAINKITVISGNNADINAPYGYLKVPGDLNRGAGGNFIYACTFVGK

SEQ ID NO: 161 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSASYTNVSGNTISEYQRSLATSVAIEGRYNFFSGSLSTDFDSNSLRNAENEFTRIQQSINLWSLRLPSVKSLRDLMLPHMRQQLDELNVNDPKAISRYFDRVGSHFLTGIVMGGRAILASSTNKLRVKRDYSVSVIAKASYEGLTGQLSAEARTKYGESMSSFTQYSSTHQEVRGGDGTKAHGVFEGKAGFQAWVDSVGTSPDFVDFVPTIPMLEIWTLCSSEAQAEAMRKHYDDVWAPAQSEKYRVKANCIDQLVVITGDSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 162 - protein, 483 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTVTEYQRSLAVSVAIEGRYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVVAKASYEGLTGQLSAEAKAKYGESISSFTQYSNTHQEVRGGDGAKAHGVFEGKAGFQAWVDSVSASPDFVDFVPTIPMLEIWSLCKTDSRAEAMKRHFDTVWAREQSDKYRIKANYIDQLVVITGGSSTIEPPVGYSKIEYDLNAGAGGDFIYLCYHEQTWYPDNTKPAVTAIKIIYDREPVPTGYTKLPQDLNKGAGGDDVFLCYKTEAYNTDTAINKVTVIGGNNPDINAPYGYEKVPGDLNKGAKGNFIYACTFVGK

SEQ ID NO: 163 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDYDENSLRNAENEFTRIQQSINLWSLRLPSVKSLRDLMLPHMREQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTAIKIIYDREPVPTGYIKLPQDLNKGAGGADIYLCYKLEGYNTDTAINKITVISGNNPDINAPYGYEKVPGDLNKGAKGNFIYACTFVGK

SEQ ID NO: 164 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDYDENSLRNAENEFTRIQQSINLWSLRLPSVKSLRDLMLPHMRQQLDELNVNDPKAISRYFDRVGSHFLTGIVMGGRAILAASTNKLKVKRDYSVSVIAKASYEGLTGQLSAEARTKYGESMSSFTQYSNTHQEVRGGDGTKAHGVFEGKAGFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYEKVPGDLNKGAKGNFIYACTFVGK

SEQ ID NO: 165 - protein, 483 aa, Artificial Sequence
  IPD090 variant
MEHVDLPTGLVKFSSNHHLQLLRDTADLSESVLPGVEAIGLGYNPFISYASVNSGAVQLFDWATAKKREVPFKAGYFVPEIVDVQQNDSATYTNVSGNTVTEYQRSLAVSVAIEGRYNFFSGSLSTDFDSNSLRNAENEFTRIQQSINLWSLRLPSVKSLRELMLPHMREQLDELDVKNPSAISRFFDRVGSHFLTGIVMGGRAILASSTNKLRVKRDYSVSVIAKASYEGLTGQLSAEARTKYGESMSSFTQYSSTHQEVRGGDGTKAHGVFEGKAGFQAWVDSVGTSPDFVDFVPTIPMLEIWSLCKTDSQAEAMKRHFDTVWAREQSDKYRIKANYIDQLVVITGDSSTIEPPAGYTKIPYDLNAGAKGDFIYLCYHEQAWYPDNTKPAVTAIKIIYDREPVPTGYIKLPQDLNKGAGGDDVFLCYKTEAYNTDTAINKVTVISGNNPDINAPYGYEKVPGDLNKGAKGNFIYACTFVGK

SEQ ID NO: 166 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVVAKASYEGLTGQLSAEAKAKYGESISSFTQYSNTHQEVRGGDGAKAHGVFSGKKEDFQAWVDSVSASPDFVDFVPTIPMQEIWSLCKTDSQAEAMKRHFDTVWAREQSDKYRIKANYIDQLVVITGDSSTIEPPAGYTKIPYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 167 - protein, 483 aa, Artificial Sequence
  IPD090 variant
MENIDLPQGLVNFSTQHLQLIRFKAGLNETVLPGVEAIGLGYNPFISYAGVGSGTVQLFDWATAKKREVPFKAGYFVPEIVDVQQNDSATYTNVSGNTITEYQRSLATSVAIEGRYNFFSGSLSTDFDSNSLRNAENEFARIQQSINLWSLRLPSVKSLRELMLPHMREQLDELDVKNPSAISRFFDRVGSHFLTGIVMGGRAILASSTNKLRVKRDYSVSVVAKASYEGLTGQLSAEARTKYGESMSSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGDSSTIEPPAGYTKIPYDLNAGAKGDFIYLCYHEQAWYPDNTKPAVTAIKIIYDREPVPTGYIKLPQDLNKGAGGADIYLCYKLEGYNTDTAINKVTVIGGNNADINAPYGYLKVPGDLNRGAGGNFIYACTFVGK

SEQ ID NO: 168 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVIAKASYEGLTGQLSAEARTKYGESMSSFTQYSSTHQEVRGGDGTKAHGVFEGKAGFQAWVDSVSASPDFVDFVPTIPMQEIWTLCSSEAQAEAMRKHYDDVWAPAQSEKYRVKANYIDQLVVITGDSSTIEPPAGYTKIPYDLNAGAKGDFIYLCYHEQAWYPDNTKPAVTAIKIIYDREPVPTGYIKLPQDLNKGAGGDDVFLCYKTEAYNTDTAINKVTVIGGNNADINAPYGYLKVPGDLNRGAGGNFIYACTFVGK

SEQ ID NO: 169 - protein, 483 aa, Artificial Sequence
  IPD090 variant
MEHVDLPTGLVKFSSNHHLQLLRDTADLSESVLPGVEAIGLGYNPFISYASVNSGAVQLFDWATAKKREVPFKAGYFVPEIVDVQQNDSASYTNISGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLKVKRDYSVSVVAKASYEGLTGQLSAEARTKYGESISSFTQYSSTHQEVRGGDGTKAHGVFEGKAGFQAWVDSVGTSPDFVDFVPTIPMLEIWSLCKTDSQAEAMKRHFDTVWAREQSDKYRIKANYIDQLVVITGDSSTIEPPAGYTKIPYDLNAGAKGDFIYLCYHEQAWYPDNTKPAVTAIKIIYDRESVPTGYIKLPQDLNKGAGGADIYLCYKLEGYNTDTAINKITVISGNNPDINAPYGYLKVPGDLNRGAGGNFIYACTFVGK

SEQ ID NO: 170 - protein, 483 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILAASTNKLKVKRDYSVSVIAKASYEGLTGQLSAEAKAKYGESISSFTQYSSTHQEVRGGDGTKAHGVFEGKAGFQAWVDSVGTSPDFVDFVPTIPMLEIWSLCKTDSQAEAMKRHFDTVWAREQSDKYRIKANYIDQLVVITGGSSTIEPPVGYTKIPYDLNAGAGGDFIYLCYHEQTWQADRPKDAVTDIRIIFNKEPTPPGYTKLPQDLNKGAGGADIYLCYKLEGYNTDTAINKITVISGNNPDINAPYGYEKVPGDLNKGAKGNFIYACTFVGK

SEQ ID NO: 171 - protein, 484 aa, Artificial Sequence
  IPD090 variant
MEHVDLPTGLVKFSSNHHLQLLRDTADLSESVLPGVEAIGLGYNPFLGYASVNSGAVQLFDWATAKKREVPFKAGYFVPEIVDVQQNDSATYTNVSGNTISEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTDQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGDSSTIEPPVGYSKIEYDLNAGAGGDFIYLCYHEQTWQADRPKDAVTDIRIIYNKEPTPPGYTKLPQDLNKGAGGDDVFLCYKTEAYNTDTAINKVTVIGGNNPDINAPYGYEKVPGDLNKGAGGNFIYACTFVGK

SEQ ID NO: 172 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDENSLRNAENEFTRIQQSINLWSLRLPSVKSLRDLMLPHMRQQLDELNVNDPKAISRYFDRVGSHFLTGIVMGGRAILASSTNKLRVKRDYSVSVIAKASYEGLTGQLSAKARTKYGESMSSFTQYSSTHQEVRGGDGAKAHGVFSGKKEDFQAWVDSVSASPDFVDFVPTIPMQEIWTLCSSEAQAEAMRKHYDDVWAPAQSEKYRIKANYIDQLVVITGDSSTIEPPAGYTKIPYDLNAGAKGDFIYLCYHEQAWYPDNTKPAVTAIKIIYDREPVPTGYIKLPQDLNKGAGGDDVFLCYKTEAYNTDTAINKVTVIGGNNADINAPYGYLKVPGDLNRGAGGNFIYACTFVGK

SEQ ID NO: 173 - protein, 483 aa, Artificial Sequence
  IPD090 variant
MEHVDLPTGLVKFSSNHHLQLLRDTADLSESVLPGVEAIGLGYNPFLGYASVNSGAVQLFDWATAKKREVPFKAGYFVPEIVDVQQNDSATYTNVSGNTISEYQRSLATSVAIEGKYNFFSGSLSTDYDENSLRNAENEFTRIQQSINLWSLRLPSVKSLRDLMLPHMREQLDELDVKNPSAISRYFDRVGSHFLTGIVMGGRAILAASTNKLKVKRDYSVSVIAKASYEGLTGQLSAEARTKYGESMSSFTQYSSTHQEVRGGDGTKAHGVFEGKAGFQAWVDSVGTSPDFVDFVPTIPMQEIWTLCSSEAQAEAMRKHYDDVWAPAQSEKYRVKANYIDQLVVITGGSSTIEPPVGYTKIPYDLNAGAGGDFIYLCYHEQTWQADRPKDAVTDIRIIFNKEPTPPGYTKLPQDLNKGAGGDDIYLCYKLEGYNTDTAINKITVISGNNPDINAPYGYLKVPGDLNRGAGGNFIYACTFVGK

SEQ ID NO: 174 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVPFKPEFVVPEIVDVQQNDSATYTNVSGNTISEYQRSLATSVAIEGRYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEARTKYGESMSSFTQYSSTHQEVRGGDGTKAHGVFEGKAGFQAWVDSVSASPDFVDFVPTIPMQEIWTLCSSEAQAEAMRKHYDDVWAPAQSEKYRVKANYIDQLVVITGDSSTIEPPVGYSKIEYDLNAGAGGDFIYLCYHEQTWQADRPKDAVTDIRIIFNKEPTPTGYIKLPQDLNKGAGGADIYLCYKLEGYNTDTAINKITVISGNNPDINAPYGYEKVPGDLNRGAGGNFIYACTFVGK

SEQ ID NO: 175 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRDLMLPHMREQLDELDVNDPKAISRYFDRVGSHFLTGIVMGGRAILASSTNKLRVKRDYSVSVVAKASYEGLTGQLSAEARTKYGESMSSFTQYSSTHQEVRGGDGTKAHGVFEGKAGFQAWVDSVGTSPDFVDFVPTIPMLEIWSLCKTDSQAEAMKRHFDTVWAREQSDKYRIKANYIDQLVVITGDSSTIEPPAGYTKIPYDLNAGAKGDFIYLCYHEQAWYPDNTKPAVTAIKIIYDREPVPTGYIKLPQDLNKGAGGDDVFLCYKTEAYNTDTAINKVTVIGGNNADINAPYGYLKVPGDLNRGAGGNFIYACTFVGK

SEQ ID NO: 176 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILAASTNKLKVKRDYSVSVIAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPAGYTKIEYDLNAGAGGDFIYLCYHEQAWYPDNTKPAVTAIKIIYDREPVPTGYIKLPQDLNKGAGGADIYLCYKLEGYNTDTAINKVTVIGGNNADINAPYGYLKVPGDLNRGAGGNFIYACTFVGK

SEQ ID NO: 177 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVIAKASYEGLTGQLSAEARTKYGESMSSFTQYSSTHQEVRGGDGTKAHGVFEGKAGFQAWVDSVGTSPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 178 - protein, 483 aa, Artificial Sequence
  IPD090 variant
MENIDLPQGLVNFSTQHLQLILFIACLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 179 - protein, 483 aa, Artificial Sequence
  IPD090 variant
MENIDLPQGLVNFSTQHLQLIRFKAGLNETVLPGVEAIGLGYNPFISYASVNSGAVQLFDWNNAKKKKVSFKPEFVVPEIVDVQQNDSATYTNVSGNTVTEYQRSLATSVAIEGRYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVVAKASYEGLTGQLSAEAKAKYGESISSFTQYSNTHQEVRGGDGAKAHGVFSGKKEDFQAWVDSVSASPDFVDFVPTIPMLEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 180 - protein, 482 aa, Artificial Sequence
  IPD090 variant
MENIDLPQGLVNFSTQHLQLIRFKAGLNETVLPGVEAIGLGYNPFLGYASVNSGAVQLFDWATAKKREVPFKAGYFVPEIVDVQQNDSATYTNVSGNTISEYQRSLATSVAIEGRYNFFSGSLSTDYDENSLRNAENEFTRIQQSINLWSLRLPSVKSLRDLMLPHMRQQLDELNVNDPKAISRYFDRVGSHFLTGIVMGGRAILAASTNKLRVKRDYSVSVIAKASYEGLTGQLSAEARTKYGESMSSFTQYSSTHQEVRGGDGTKAHGVFEGKAGFQAWVDSVGTSPDFVDFVPTIPMLEIWTLCSSEAQAEAMRKHYDDVWAPAQSEKYRVKANYIDQLVVITGGSSTIEPPVGYSKIEYDLNVGAGGDFIYLCYHEQTWQADRPKDAVTDIRIIFNKEPTPPGYTKLPQDLNKGAGGDDVFLCYKTEAYNTDTAINKVTVIGGNNADINAPYGYEKVPGDLNKGAKGNFIYACTFVGK

SEQ ID NO: 181 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTVSEYQRSLATSVAIEGRYNFFSGSLSTDYDENSLRNAENEFTRIQQSINLWSLRLPSVKSLRDLMLPHMREQLDELDVKNPSAISRFFDRVGSHFLTGIVMGGRAILASSTNKLRVKRDYSVSVVAKASYEGLTGQLSAEARTKYGESMSSFTQYSSTHQEVRGGDGTKAHGVFEGKAGFQAWVDSVSASPDFVDFVPTIPMQEIWTLCSSEAQAEAMRKHYDDVWAPAQSEKYRVKANYIDQLVVITGDSSTIEPPAGYTKIPYDLNAGAKGDFIYLCYHEQAWYPDNTKPAVTAIKIIYDREPVPTGYIKLPQDLNKGAGGADIYLCYKLEGYNTDTAINKITVISGNNPDINAPYGYLKVPGDLNRGAKGNFIYACTFVGK

SEQ ID NO: 182 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSASYTNVSGNTISEYQRSLATSVAIEGRYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEAKAKYGESISSFTQYSNTHQEVRGGDGTKAHGVFEGKAGFQAWVDSVGTSPDFVDFVPTIPMLEIWTLCSSEAQAEAMRKHYDDVWAPAQSEKYRVKANYIDQLVVITGDSSTIEPPAGYTKIPYDLNAGAKGDFIYLCYHEQAWYPDNTKPAVTAIKIIYDREPVPTGYIKLPQDLNKGAGGADIYLCYKTEAYNTDTAINKVTVIGGNNADINAPYGYLKVPGDLNRGAGGNFIYACTFVGK

SEQ ID NO: 183 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMREQLDELDVKNPSAISRFFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGDSSTIEPPAGYTKIPYDLNAGAKGDFIYLCYHEQAWYPDNTKPAVTAIKIIYDREPVPTGYIKLPQDLNKGAGGADIYLCYKTEAYNTDTAINKVTVIGGNNADINAPYGYEKVPGDLNKGAKGNFIYACTFVGK

SEQ ID NO: 184 - protein, 483 aa, Artificial Sequence
  IPD090 variant
MENIDLPQGLVNFSTQHPQLIRFKAGLNETVLPGVEAIGLGYNPFISYASVNSGAVQLFDWATAKKREVPFKAGYFVPEIVDVQQNDSATYTNVSDNTVTEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILAASTNKLRVKRDYSVSVVAKASYEGLTGQLSAEAKAKYGESISSFTQYSSTHQEVRGGDGTKAHGVFSGKKEDFQAWVDSVSASPDFVDFVPTIPMQEIWTLCSSEAQAEAMRKHYDDVWAPAQSEKYRVKANYIDQLVVITGGSSTIEPPAGYTKIPYDLNAGAKGDFIYLCYHEQAWYPDNTKPAVTAIKIIYDREPVPTGYIKLPQDLNKGAGGADIYLCYKLEGYNTDTAINKVTVISGNNADINAPYGYLKVPGDLNRGAGGNFIYACTFVGK

SEQ ID NO: 185 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTVTEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEARTKYGESISSFTQYSNTHQEVRGGDGAKAHGVFEGKAGFQAWVDSVGTSPDFVDFVPTIPMQEIWTLCSSEAQAEAMRKHYDDVWAPAQSEKYRVKANYIDQLVVITGGSSTIEPPVGYSKIEYDLNAGAGGDFIYLCYHKQTWQADRPKDAVTDIRIIFNKEPTPPGYTKLPQDLNKGAGGDDVFLCYKTEAYNTDTAINKITVISGNNPDINAPYGYEKVPGDLNKGAKGNFIYACTFVGK

SEQ ID NO: 186 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGKYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLKVKRDYSVSVIAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSDKYRIKANYIDQLVVITGGSSTIEPPAGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNKGAKGNFIYACTFVGK

SEQ ID NO: 187 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTVTEYQRSLAVSVAIEGKYNFFSGSLSTDYDENSLRNAENEFTRIQQSINLWSLRLPSVKSLRDLMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVGTSPDFVDFVPTIPMLEIWSLCKTDSQAEAMKRHFDTVWAREQSDKYRIKANYIDQLVVITGDSSTIEPPAGYTKIPYDLNAGAKGDFIYLCYHEQAWYPDNTKPAVTAIKIIYDREPVPTGYIKLPQDLNKGAGGADIYLCYKLEGYNTDTAINKITVISGNNADINAPYGYLKVPGDLNRGAGGNFIYACTFVGK

SEQ ID NO: 188 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVIAKASYEGLTGQLSAEARTKYGESMSSFTQYSSTHQEVRGGDGTKAHGVFEGKAGFQAWVDSVGTSPDFVDFVPTIPMQEIWTLCSSEAQAEAMRKHYDDVWAPAQSEKYRVKANYIDQLVVITGDSSTIEPPAGYTKIPYDLNAGAGGDFIYLCYHEQTWQADRPKDAVTDIRIIFNKEPTPPGYTKLPQDLNKGAGGDDVFLCYKTEAYNTDTAINKITVIGGNNADINAPYGYLKVPGDLNRGAGGNFIYACTFVGK

SEQ ID NO: 189 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSASYTNVSGNTISEYQRSLAVSVAIEGKYNFFSGSLSTDYDENSLRNAENEFTRIQQSINLWSLRLPSVKSLRDLMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGDSSTIEPPAGYTKIPYDLNAGAKGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 190 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTITEYQRSLAVSVAIEGRYNFFSGSLSTDFDSNSLRNAENEFTRIQQSINLWSLRLPSVKSLRDLMLPHMREQLDELDVKNPSAISRFFDRVGSHFLTGIVMGGRAILASSTNKLRVKRDYSVSVVAKASYEGLTGQLSAEAKAKYGESISSFTQYSNTHQEVRGGDGTKAHGVFEGKAGFQAWVDSVGTSPDFVDFVPTIPMLEIWSLCKTDSQAEAMKRHFDTVWAREQSDKYRIKANYIDQLVVITGDSSTIEPPAGYTKIPYDLNAGAKGDFIYLCYHEQTWQADRPKDAVTDIRIIFNKEPTPPGYTKLPQDLNKGAGGDDVFLCYKTEAYNTDTAINKVTVIGGNNADINAPYGYEKVPGDLNKGAKGNFIYACTFVGK

SEQ ID NO: 191 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEARTKYGESMSSFTQYSSTHQEVRGGDGTKAHGVFEGKAGFQAWVDSVGTSPDFVDFVPTIPMLEIWSLCKTDSQAEAMKRHFDTVWAREQSDKYRIKANYIDQLVVITGDSSTIEPPAGYTKIPYDLNASAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 192 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMREQLDELNVNDPKAISRYFDRVGSHFLTGIVMGGRAILASSTNKLKVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGDSSTIEPPAGYTKIPYDLNAGAGGDFIYLCYHEQAWYPDNTKPAVTAIKIIYDREPVPTGYIKLPQDLNKGAGGADIYLCYKLEGYNTDTAINKITVISGNNPDINAPYGYEKVPGDLNKGAGGNFIYACTFVGK

SEQ ID NO: 193 - protein, 484 aa, Artificial Sequence
  IPD090 variant
MEHVDLPTGLVKFSSNHHLQLLRDTADLSESVLPGVEAIGLGYNPFISYASVNSGAVQLFDWATAKKREVPFKAGYFVPEIVDVQQNDSASYTNISGNTISEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEARTKYGESMSSFTQYSSTHQEVRGGDGAKAHGVFSGKKEDFQAWVDSVSASPDFVDFVPTIPMLEIWSLCKTDSQAEAMKRHFDTVWAREQSDKYRIKANYIDQLVVITGDSSTIEPPAGYTKIPYDLNAGAKGDFIYLCYHEQTWQADRPKDAVTDIRIIFNKEPTPPGYTKLPQDLNKGAGGDDVFLCYKTEAYNTDTAINKITVISGNNPDINAPYGYEKVPGDLNKGAKGNFIYACTFVGK

SEQ ID NO: 194 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRDLMLPHMREQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPAGYTKIPYDLNAGAKGDFIYLCYHEQAWYPDNTKPAVTAIKIIYDREPVPTGYIKLPQDLNKGAGGADIYLCYKLEGYNTDTAINKITVISGNNPDINAPYGYEKVPGDLNKGAKGNFIYACTFVGK

SEQ ID NO: 195 - protein, 484 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTVTEYQRSLAVSVAIEGKYNFFSGSLSTDYDENSLRNAENEFTRIQQSINLWSLRLPSVKSLRDLMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMLEIWTLCSSEAQAEAMRKHYDDVWAPAQSEKYRVKANYIDQLVVITGGSSTIEPPVGYSKIEYDLNAGAGGDFIYLCYHEQAWYPDNTKPAVTAIKIIYDREPVPTGYIKLPQDLNKGAGGADIYLCYKLEGYNTDTAINKIMVISGNNPDINAPYGYEKVPGDLNRGAGGNFIYACTFVGK

SEQ ID NO: 196 - protein, 484 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTVTEYQRSLAVSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLKVKRDYSVSVIAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGDSSTIEPPAGYTKIPYDLNAGAKGDFIYLCYHEQAWYPDNTKPAVTAIKIIYDREPVPTGYIKLPQDLNKGAGGADIYLCYKLEGYNTDTAINKITVISGNNPDINAPYGYLKVPGDLNRGAGGNFIYACTFVGK

SEQ ID NO: 197 - protein, 482 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSASYTNISGNTVTEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILASSTNKLRVKRDYSVSVVAKASYEGLTGQLSAEARTKYGESMSSFTQYSSTHQEVRGGDGTKAHGVFEGKAGFQAWVDSVGTSPDFVDFVPTIPMQEIWTLCSSEAQAEAMRKHYDDVWAPAQSEKYRVKANYIDQLVVITGDSSTIEPPVGYSKIPYDLNAGAKGDFIYLCYHEQAWYPDNTKPAVTAIKIIYDREPVPTGYIKLPQDLNKGAGGDDVFLCYKTEAYNTDTAINKVTVIGGNNADINAPYGYLKVPGDLNRGAGGNFIYACTFVGK

SEQ ID NO: 198 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDYDENSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEARTKYGESMSSFTQYSSTHQEVRGGDGAKAHGVFSGKKEDFQAWVDSVGTSPDFVDFVPTIPMLEIWSLCKTDSQAEAMKRHFDTVWAREQSDKYRIKANYIDQLVVITGDSSTIEPPAGYTKIPYDLNAGAGGDFIYLCYHEQAWYPDNTKPAVTAIKIIYDREPVPTGYIKLPQDLNKGAGGADIYLCYKLEGYNTDTAINKITVISGNNPDINAPYGYEKVPGDLNKGAKGNFIYACTFVGK

SEQ ID NO: 199 - protein, 483 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSATYTNISGNTVTEYQRSLAVSVAIEGRYNFFSGSLSTDYDENSLRNAENEFTRIQQSINLWSLRLPSVKSLRELMLPHMRQQLDELNVNDPKAISRYFDRVGSHFLTGIVMGGRAILAASTNKLKVKRDYSVSVIAKASYEGLTGQLSAEARTKYGESMSSFTQYSSTHQEVRGGDGTKAHGVFEGKAGFQAWVDSVSASPDFVDFVPTIPMQEIWTLCSSEAQAEAMRKHYDDVWAPAQSEKYRVKANYIDQLVVITGGSSTIEPPAGYTKIPYDLNAGAKGDFIYLCYHEQAWYPDNTKPAVTAIKIIYDREPVPTGYIKLPQDLNKGAGGDDVFLCYKTEAYNTDTAINKVTVIGGNNADINAPYGYLKVPGDLNRGAGGNFIYACTFVGK

SEQ ID NO: 200 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEAKAKYGESISSFTQYSSTHQEVRGGDGAKAHGVFSGKKEDFQAWVDSVSASPDFVDFVPTIPMQEIWTLCSSEAQAEAMRKHYDDVWAPTQSEKYRVKANYIDQLVVITGGSSTIEPPVGYSKIEYDLNAGAKGDFIYLCYHEQAWYPDNTKPAVTAIKIIYDREPVPTGYIKLPQDLNKGAGGADIYLCYKLEGYNTDTAINKITVISGNNPDINAPYGYEKVPGDLNKGAKGNFIYACTFVGK

SEQ ID NO: 201 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSASYTNISGNTVTEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPAGYTKIPYDLNAGAKGDFIYLCYHEQTWQADRPKDVVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 202 - protein, 483 aa, Artificial Sequence
  IPD090 variant
MEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTVTEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVVAKASYEGLTGQLSAEARTKYGESMSSFTQYSSTHQEVRGGDGTKAHGVFEGKAGFQAWVDSVSASPDFVDFVPTIPMQEIWTLCKTDSQAEAMRKHYDDVWAREQSDKYRIKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 203 - DNA, 1473 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagcccttggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaagctcgagcaccaccaccaccaccac

SEQ ID NO: 204 - DNA, 1473 bp, Artificial Sequence
  IPD090 variant
atggaaaacctagacttgccacaaggacttgtaaacttttccacgcaacacctgcaacttattcgttttaaagcaggtttgaatgaaaccgtactacctggcgtcgaagcccttggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcctctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaagctcgagcaccaccaccaccaccac

SEQ ID NO: 205 - DNA, 1473 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacctcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaagctcgagcaccaccaccaccaccac

SEQ ID NO: 206 - DNA, 1473 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcctctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaagctcgagcaccaccaccaccaccac

SEQ ID NO: 207 - DNA, 1467 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaagcaccaccaccaccaccac

SEQ ID NO: 208 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcatttcgatgacgtctgggcgccggcgcaatcggaaaagttccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcaatcaacaaggtcacggtcctcggcggcaacaatgcggatctcaacgctccctatggttatctgaaggtccccggtgacctcaacagaggtgctggcggcaacttcatctatgcctgtaccttcgtaggcaag

SEQ ID NO: 209 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcatttcgatgacgtctgggcgccggcgcaatcggaaaagttccgggtcaaggctaactacatcgaccaactggtggtcatcaccggcggtagttcaaccctcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcaatcaacaaggtcacggtcatcggcggcaacaatgcggatctcaacgctccctatggttatctgaaggtccccggtgacctcaacagaggtgctggcggcaacttcatctatgcctgtaccttcgtaggcaag

SEQ ID NO: 210 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccctcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcactcaacaaggtcacggtcatcggcggcaacaatgcggatatcaacgctccctttggttatctgaaggtccccggtgacctcaacagaggtgctggcggcaacttcatctatgcctgtaccttcgtaggcaag

SEQ ID NO: 211 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacctcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcctcggcggcaacaatgcggatatcaacgctccctttggttatctgaaggtccccggtgacctcaacagaggtgctggcggcaacttcatctatgcctgtaccttcgtaggcaag

SEQ ID NO: 212 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 213 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaacttcatcgaccaactggtggtcatcaccggcggtagttcaaccctcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcactcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 214 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcatttcgatgacgtctgggcgccggcgcaatcggaaaagttccgggtcaaggctaactacctcgaccaactggtggtcctcaccggcggtagttcaaccatcgaaccaccggtcggctacagcaagctcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcactcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 215 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 216 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaacttcatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctttggttatctgaaggtccccggtgacctcaacagaggtgctggcggcaacttcatctatgcctgtaccttcgtaggcaag

SEQ ID NO: 217 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccatcgaaccaccggtcggctacagcaagctcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcctcggcggcaacaatgcggatatcaacgctccctatggttatctgaaggtccccggtgacctcaacagaggtgctggcggcaacttcatctatgcctgtaccttcgtaggcaag

SEQ ID NO: 218 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccatcgaaccaccggtcggctacagcaagctcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 219 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcactcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 220 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcatttcgatgacgtctgggcgccggcgcaatcggaaaagttccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 221 - DNA, 1008 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcgaaagttccgggtcaaggc

SEQ ID NO: 222 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagctcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcactcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 223 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccatcgaaccaccggtcggctacagcaagctcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 224 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcatttcgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcactcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 225 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcctcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcactcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 226 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcatttcgatgacgtctgggcgccggcgcaatcggaaaagttccgggtcaaggctaactacatcgaccaactggtggtcatcaccggcggtagttcaaccatcgaaccaccggtcggctacagcaagctcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcactcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 227 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaacttcatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 228 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccctcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcaatcaacaaggtcacggtcctcggcggcaacaatgcggatatcaacgctccctatggttatctgaaggtccccggtgacctcaacagaggtgctggcggcaacttcatctatgcctgtaccttcgtaggcaag

SEQ ID NO: 229 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcactcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 230 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcctcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcactcaacaaggtcacggtcatcggcggcaacaatgcggatatcaacgctccctttggttatctgaaggtccccggtgacctcaacagaggtgctggcggcaacttcatctatgcctgtaccttcgtaggcaag

SEQ ID NO: 231 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacctcgaccaactggtggtcatcaccggcggtagttcaaccatcgaaccaccggtcggctacagcaagctcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 232 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacctcgaccaactggtggtcctcaccggcggtagttcaaccatcgaaccaccggtcggctacagcaagctcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 233 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccctcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 234 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcctcaccggcggtagttcaaccatcgaaccaccggtcggctacagcaagctcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcactcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 235 - DNA, 1176 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcatttcgatgacgtctgggcaccggcgcaatcggaaaagttccgggtcaaggctaactacctcgaccaactggtggtcatcaccggcggtattcaaccctcgaaccaccggtcggctacagcaagatcgagtacgacctcaatgccggtgccggcggtgacttcatctacttgtgctatcacgaacaaacctggcaggccgacaggcctaaagatgctg

SEQ ID NO: 236 - DNA, 1377 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacctcgaccaactggtggtcatcaccggcggtagttcaaccatcgaaccaccggtcggctacagcaagctcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgcaccgcactcaacaaggtcacggtcctcggcggcaacaatgcggatatcaacgctccctttggttatc

SEQ ID NO: 237 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacctcgaccaactggtggtcatcaccggcggtagttcaaccatcgaaccaccggtcggctacagcaagctcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 238 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacctcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 239 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcctcggcggcaacaatgcggatatcaacgctccctatggttatctgaaggtccccggtgacctcaacagaggtgctggcggcaacttcatctatgcctgtaccttcgtaggcaag

SEQ ID NO: 240 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 241 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 242 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaacttcatcgaccaactggtggtcctcaccggcggtagttcaaccctcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcactcaacaaggtcacggtcatcggcggcaacaatgcggatatcaacgctccctttggttatctgaaggtccccggtgacctcaacagaggtgctggcggcaacttcatctatgcctgtaccttcgtaggcaag

SEQ ID NO: 243 - DNA, 1176 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgaagcatttcgatgacgtctgggcgccggcgcaatcggaaaagttccgggtcaaggctaactacctcgaccaactggtggtcatcaccggcggtagttcaaccctcgaaccaccggtcggctacagcaagctcgagtacgacctcaatgccggtgccggcggtgacttcatctacttgtgctatcacgaacaaacctggcaggccgacaggcctaaagatgctg

SEQ ID NO: 244 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcctcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcactcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 245 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcatttcgatgacgtctgggcgccggcgcaatcggaaaagttccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 246 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccatcgaaccaccggtcggctacagcaagctcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatctcaacgctccctatggttatctgaaggtccccggtgacctcaacagaggtgctggcggcaacttcatctatgcctgtaccttcgtaggcaag

SEQ ID NO: 247 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcactcaacaaggtcacggtcatcggcggcaacaatgcggatatcaacgctccctttggttatctgaaggtccccggtgacctcaacagaggtgctggcggcaacttcatctatgcctgtaccttcgtaggcaag

SEQ ID NO: 248 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcctcaccggcggtagttcaaccatcgaaccaccggtcggctacagcaagctcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcactcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 249 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcatttcgatgacgtctgggcgccggcgcaatcggaaaagtaccgggtcaaggctaactacatcgaccaactggtggtcctcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcaatcaacaaggtcacggtcatcggcggcaacaatgcggatatcaacgctccctttggttatctgaaggtccccggtgacctcaacagaggtgctggcggcaacttcatctatgcctgtaccttcgtaggcaag

SEQ ID NO: 250 - DNA, 1176 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgagccatgcgcaagcatttcgatgacgtctgggcgccggcgcaatcggaaaagttccgggtcaaggctaactacatcgaccaactggtggtcatcaccggcggtagttcaaccctcgaaccaccggtcggctacagcaagatcgagtacgacctcaatgccggtgccggcggtgacttcatctacttgtgctatcacgaacaaacctggcaggccgacaggcctaaagatgctg

SEQ ID NO: 251 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcatttcgatgacgtctgggcgccggcgcaatcggaaaagtaccgggtcaaggctaactacctcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcactcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 252 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcctcggcggcaacaatgcggatatcaacgctccctatggttatctgaaggtccccggtgacctcaacagaggtgctggcggcaacttcatctatgcctgtaccttcgtaggcaag

SEQ ID NO: 253 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctttggttatctgaaggtccccggtgacctcaacagaggtgctggcggcaacttcatctatgcctgtaccttcgtaggcaag

SEQ ID NO: 254 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacctcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcactcaacaaggtcacggtcatcggcggcaacaatgcggatatcaacgctccctttggttatctgaaggtccccggtgacctcaacagaggtgctggcggcaacttcatctatgcctgtaccttcgtaggcaag

SEQ ID NO: 255 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 256 - DNA, 1449 bp, Artificial Sequence; identical to SEQ ID NO: 241
  IPD090 variant

SEQ ID NO: 257 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcatttcgatgacgtctgggcgccggcgcaatcggaaaagttccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcactcaacaaggtcacggtcatcggcggcaacaatgcggatatcaacgctccctttggttatctgaaggtccccggtgacctcaacagaggtgctggcggcaacttcatctatgcctgtaccttcgtaggcaag

SEQ ID NO: 258 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcctcggcggcaacaatgcggatatcaacgctccctatggttatctgaaggtccccggtgacctcaacagaggtgctggcggcaacttcatctatgcctgtaccttcgtaggcaag

SEQ ID NO: 259 - DNA, 1449 bp, Artificial Sequence; identical to SEQ ID NO: 252
  IPD090 variant

SEQ ID NO: 260 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacctcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcactcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 261 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcctcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcaatcaacaaggtcacggtcatcggcggcaacaatgcggatatcaacgctccctttggttatctgaaggtccccggtgacctcaacagaggtgctggcggcaacttcatctatgcctgtaccttcgtaggcaag

SEQ ID NO: 262 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaacttcatcgaccaactggtggtcctcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 263 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccatcgaaccaccggtcggctacagcaagctcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 264 - DNA, 1449 bp, Artificial Sequence; identical to SEQ ID NO: 255
  IPD090 variant

SEQ ID NO: 265 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaacttcatcgaccaactggtggtcctcaccggcggtagttcaaccctcgaaccaccggtcggctacagcaagctcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcactcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 266 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcatttcgatgacgtctgggcgccggcgcaatcggaaaagttccgggtcaaggctaacttcatcgaccaactggtggtcctcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcaatcaacaaggtcacggtcatcggcggcaacaatgcggatctcaacgctccctatggttatctgaaggtccccggtgacctcaacagaggtgctggcggcaacttcatctatgcctgtaccttcgtaggcaag

SEQ ID NO: 267 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcatttcgatgacgtctgggcgccggcgcaatcggaaaagttccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcaatcaacaaggtcacggtcctcggcggcaacaatgcggatatcaacgctccctatggttatctgaaggtccccggtgacctcaacagaggtgctggcggcaacttcatctatgcctgtaccttcgtaggcaag

SEQ ID NO: 268 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaaaccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaacttcatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatctcaacgctccctatggttatctgaaggtccccggtgacctcaacagaggtgctggcggcaacttcatctatgcctgtaccttcgtaggcaag

SEQ ID NO: 269 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggctttcaacaccgacaccgcaatcaacaaggtcacggtcatcggcggcaacaatgcggatatcaacgctccctttggttatctgaaggtccccggtgacctcaacagaggtgctggcggcaacttcatctatgcctgtaccttcgtaggcaag

SEQ ID NO: 270 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcatttcgatgacgtctgggcgccggcgcaatcggaaaagttccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatctcaacgctccctatggttatctgaaggtccccggtgacctcaacagaggtgctggcggcaacttcatctatgcctgtaccttcgtaggcaag

SEQ ID NO: 271 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaaccttcaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccctcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 272 - DNA, 1449 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagctcgtcgacgtgcaacagaacgacagcgcaacctacaccaacgtcagcggcaacacgctcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagttccgggtcaaggctaactacatcgaccaactggtggtcatcaccggcggtagttcaaccctcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcactcaacaaggtcacggtcatcggcggcaacaatgcggatatcaacgctccctatggttatctgaaggtccccggtgacctcaacagaggtgctggcggcaacttcatctatgcctgtaccttcgtaggcaag

SEQ ID NO: 273 - DNA, 1449 bp, Artificial Sequence; identical to SEQ ID NO: 252
  IPD090 variant

SEQ ID NO: 274 - protein, 491 aa, Artificial Sequence
  IPD090 variant
MENIDLPQGLVNFSTQHLQLIRFKAGLNETVLPGVEALGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGKLEHHHHHH

SEQ ID NO: 275 - protein, 491 aa, Artificial Sequence
  IPD090 variant
MENLDLPQGLVNFSTQHLQLIRFKAGLNETVLPGVEALGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFLYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGKLEHHHHHH

SEQ ID NO: 276 - protein, 491 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYLDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGKLEHHHHHH

SEQ ID NO: 277 - protein, 491 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFLYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGKLEHHHHHH

SEQ ID NO: 278 - protein, 491 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGKLEHHHHHH

SEQ ID NO: 279 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHFDDVWAPAQSEKFRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAFNTDTAINKVTVLGGNNADLNAPYGYLKVPGDLNRGAGGNFIYACTFVGK

SEQ ID NO: 280 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHFDDVWAPAQSEKFRVKANYIDQLVVITGGSSTLEPPVGYSKIEYDLNAGAGGDFIYLCYHEQTWQADRPKDAVTDIRIIFNKEPTPPGYTKLPQDLNKGAGGDDVFLCYKTEAFNTDTAINKVTVIGGNNADLNAPYGYLKVPGDLNRGAGGNFIYACTFVGK

SEQ ID NO: 281 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTLEPPVGYSKIEYDLNAGAGGDFIYLCYHEQTWQADRPKDAVTDIRIIFNKEPTPPGYTKLPQDLNKGAGGDDVFLCYKTEAYNTDTALNKVTVIGGNNADINAPFGYLKVPGDLNRGAGGNFIYACTFVGK

SEQ ID NO: 282 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYLDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVLGGNNADINAPFGYLKVPGDLNRGAGGNFIYACTFVGK

SEQ ID NO: 283 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAFNTDTAINKVTVIGGNNADINAPYGYLKVPGDLNRGAGGNFIYACTFVGK

SEQ ID NO: 284 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANFIDQLVVITGGSSTLEPPVGYSKIEYDLNAGAGGDFIYLCYHEQTWQADRPKDAVTDIRIIFNKEPTPPGYTKLPQDLNKGAGGDDVFLCYKTEAYNTDTALNKVTVIGGNNADINAPYGYLKVPGDLNRGAGGNFIYACTFVGK

SEQ ID NO: 285 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHFDDVWAPAQSEKFRVKANYLDQLVVLTGGSSTIEPPVGYSKLEYDLNAGAGGDFIYLCYHEQTWQADRPKDAVTDIRIIFNKEPTPPGYTKLPQDLNKGAGGDDVFLCYKTEAFNTDTALNKVTVIGGNNADINAPYGYLKVPGDLNRGAGGNFIYACTFVGK

SEQ ID NO: 286 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAFNTDTAINKVTVIGGNNADINAPYGYLKVPGDLNRGAGGNFIYACTFVGK

SEQ ID NO: 287 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANFIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPFGYLKVPGDLNRGAGGNFIYACTFVGK

SEQ ID NO: 288 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTIEPPVGYSKLEYDLNAGAGGDFIYLCYHEQTWQADRPKDAVTDIRIIFNKEPTPPGYTKLPQDLNKGAGGDDVFLCYKTEAYNTDTAINKVTVLGGNNADINAPYGYLKVPGDLNRGAGGNFIYACTFVGK

SEQ ID NO: 289 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTIEPPVGYSKLEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 290 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTALNKVTVIGGNNADINAPYGYLKVPGDLNRGAGGNFIYACTFVGK

SEQ ID NO: 291 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHFDDVWAPAQSEKFRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 292 - protein, 336 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSKVPGQG

SEQ ID NO: 293 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKLEYDLNAGAGGDFIYLCYHEQTWQADRPKDAVTDIRIIFNKEPTPPGYTKLPQDLNKGAGGDDVFLCYKTEAYNTDTALNKVTVIGGNNADINAPYGYLKVPGDLNRGAGGNFIYACTFVGK

SEQ ID NO: 294 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTIEPPVGYSKLEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 295 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHFDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTALNKVTVIGGNNADINAPYGYLKVPGDLNRGAGGNFIYACTFVGK

SEQ ID NO: 296 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVLTGGSSTIEPPVGYSKIEYDLNAGAGGDFIYLCYHEQTWQADRPKDAVTDIRIIFNKEPTPPGYTKLPQDLNKGAGGDDVFLCYKTEAFNTDTALNKVTVIGGNNADINAPYGYLKVPGDLNRGAGGNFIYACTFVGK

SEQ ID NO: 297 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHFDDVWAPAQSEKFRVKANYIDQLVVITGGSSTIEPPVGYSKLEYDLNAGAGGDFIYLCYHEQTWQADRPKDAVTDIRIIFNKEPTPPGYTKLPQDLNKGAGGDDVFLCYKTEAYNTDTALNKVTVIGGNNADINAPYGYLKVPGDLNRGAGGNFIYACTFVGK

SEQ ID NO: 298 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANFIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 299 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTLEPPVGYSKIEYDLNAGAGGDFIYLCYHEQTWQADRPKDAVTDIRIIFNKEPTPPGYTKLPQDLNKGAGGDDVFLCYKTEAFNTDTAINKVTVLGGNNADINAPYGYLKVPGDLNRGAGGNFIYACTFVGK

SEQ ID NO: 300 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTALNKVTVIGGNNADINAPYGYLKVPGDLNRGAGGNFIYACTFVGK

SEQ ID NO: 301 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVLTGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTALNKVTVIGGNNADINAPFGYLKVPGDLNRGAGGNFIYACTFVGK

SEQ ID NO: 302 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYLDQLVVITGGSSTIEPPVGYSKLEYDLNAGAGGDFIYLCYHEQTWQADRPKDAVTDIRIIFNKEPTPPGYTKLPQDLNKGAGGDDVFLCYKTEAFNTDTAINKVTVIGGNNADINAPYGYLKVPGDLNRGAGGNFIYACTFVGK

SEQ ID NO: 303 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYLDQLVVLTGGSSTIEPPVGYSKLEYDLNAGAGGDFIYLCYHEQTWQADRPKDAVTDIRIIFNKEPTPPGYTKLPQDLNKGAGGDDVFLCYKTEAFNTDTAINKVTVIGGNNADINAPYGYLKVPGDLNRGAGGNFIYACTFVGK

SEQ ID NO: 304 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTLEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 305 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVLTGGSSTIEPPVGYSKLEYDLNAGAGGDFIYLCYHEQTWQADRPKDAVTDIRIIFNKEPTPPGYTKLPQDLNKGAGGDDVFLCYKTEAYNTDTALNKVTVIGGNNADINAPYGYLKVPGDLNRGAGGNFIYACTFVGK

SEQ ID NO: 306 - protein, 392 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHFDDVWAPAQSEKFRVKANYLDQLVVITGGIQPSNHRSATARSSTTSMPVPAVTSSTCAITNKPGRPTGLKML

SEQ ID NO: 307 - protein, 459 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYLDQLVVITGGSSTIEPPVGYSKLEYDLNAGAGGDFIYLCYHEQTWQADRPKDAVTDIRIIFNKEPTPPGYTKLPQDLNKGAGGDDVFLCYKTEAYNTAPHSTRSRSSAATMRISTLPLVI

SEQ ID NO: 308 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYLDQLVVITGGSSTIEPPVGYSKLEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 309 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYLDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 310 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVLGGNNADINAPYGYLKVPGDLNRGAGGNFIYACTFVGK

SEQ ID NO: 311 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAFNTDTAINKVTVIGGNNADINAPYGYLKVPGDLNRGAGGNFIYACTFVGK

SEQ ID NO: 312 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 313 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANFIDQLVVLTGGSSTLEPPVGYSKIEYDLNAGAGGDFIYLCYHEQTWQADRPKDAVTDIRIIFNKEPTPPGYTKLPQDLNKGAGGDDVFLCYKTEAFNTDTALNKVTVIGGNNADINAPFGYLKVPGDLNRGAGGNFIYACTFVGK

SEQ ID NO: 314 - protein, 392 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRSISMTSGRRRNRKSSGSRLTTSTNWWSSPAVVQPSNHRSATASSSTTSMPVPAVTSSTCAITNKPGRPTGLKML

SEQ ID NO: 315 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVLTGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTALNKVTVIGGNNADINAPYGYLKVPGDLNRGAGGNFIYACTFVGK

SEQ ID NO: 316 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHFDDVWAPAQSEKFRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 317 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTIEPPVGYSKLEYDLNAGAGGDFIYLCYHEQTWQADRPKDAVTDIRIIFNKEPTPPGYTKLPQDLNKGAGGDDVFLCYKTEAYNTDTAINKVTVIGGNNADLNAPYGYLKVPGDLNRGAGGNFIYACTFVGK

SEQ ID NO: 318 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTALNKVTVIGGNNADINAPFGYLKVPGDLNRGAGGNFIYACTFVGK

SEQ ID NO: 319 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVLTGGSSTIEPPVGYSKLEYDLNAGAGGDFIYLCYHEQTWQADRPKDAVTDIRIIFNKEPTPPGYTKLPQDLNKGAGGDDVFLCYKTEAFNTDTALNKVTVIGGNNADINAPYGYLKVPGDLNRGAGGNFIYACTFVGK

SEQ ID NO: 320 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHFDDVWAPAQSEKYRVKANYIDQLVVLTGGSSTIEPPVGYSKIEYDLNAGAGGDFIYLCYHEQTWQADRPKDAVTDIRIIFNKEPTPPGYTKLPQDLNKGAGGDDVFLCYKTEAFNTDTAINKVTVIGGNNADINAPFGYLKVPGDLNRGAGGNFIYACTFVGK

SEQ ID NO: 321 - protein, 392 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEPCASISMTSGRRRNRKSSGSRLTTSTNWWSSPAVVQPSNHRSATARSSTTSMPVPAVTSSTCAITNKPGRPTGLKML

SEQ ID NO: 322 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHFDDVWAPAQSEKYRVKANYLDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAFNTDTALNKVTVIGGNNADINAPYGYLKVPGDLNRGAGGNFIYACTFVGK

SEQ ID NO: 323 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVLGGNNADINAPYGYLKVPGDLNRGAGGNFIYACTFVGK

SEQ ID NO: 324 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPFGYLKVPGDLNRGAGGNFIYACTFVGK

SEQ ID NO: 325 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYLDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTALNKVTVIGGNNADINAPFGYLKVPGDLNRGAGGNFIYACTFVGK

SEQ ID NO: 326 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 327 - protein, 483 aa, Artificial Sequence; identical to SEQ ID NO: 312
  IPD090 variant

SEQ ID NO: 328 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHFDDVWAPAQSEKFRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTALNKVTVIGGNNADINAPFGYLKVPGDLNRGAGGNFIYACTFVGK

SEQ ID NO: 329 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVLGGNNADINAPYGYLKVPGDLNRGAGGNFIYACTFVGK

SEQ ID NO: 330 - protein, 483 aa, Artificial Sequence; identical to SEQ ID NO: 323
  IPD090 variant

SEQ ID NO: 331 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYLDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTALNKVTVIGGNNADINAPYGYLKVPGDLNRGAGGNFIYACTFVGK

SEQ ID NO: 332 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVLTGGSSTIEPPVGYSKIEYDLNAGAGGDFIYLCYHEQTWQADRPKDAVTDIRIIFNKEPTPPGYTKLPQDLNKGAGGDDVFLCYKTEAFNTDTAINKVTVIGGNNADINAPFGYLKVPGDLNRGAGGNFIYACTFVGK

SEQ ID NO: 333 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANFIDQLVVLTGGSSTIEPPVGYSKIEYDLNAGAGGDFIYLCYHEQTWQADRPKDAVTDIRIIFNKEPTPPGYTKLPQDLNKGAGGDDVFLCYKTEAFNTDTAINKVTVIGGNNADINAPYGYLKVPGDLNRGAGGNFIYACTFVGK

SEQ ID NO: 334 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTIEPPVGYSKLEYDLNAGAGGDFIYLCYHEQTWQADRPKDAVTDIRIIFNKEPTPPGYTKLPQDLNKGAGGDDVFLCYKTEAFNTDTAINKVTVIGGNNADINAPYGYLKVPGDLNRGAGGNFIYACTFVGK

SEQ ID NO: 335 - protein, 483 aa, Artificial Sequence; identical to SEQ ID NO: 326
  IPD090 variant

SEQ ID NO: 336 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANFIDQLVVLTGGSSTLEPPVGYSKLEYDLNAGAGGDFIYLCYHEQTWQADRPKDAVTDIRIIFNKEPTPPGYTKLPQDLNKGAGGDDVFLCYKTEAYNTDTALNKVTVIGGNNADINAPYGYLKVPGDLNRGAGGNFIYACTFVGK

SEQ ID NO: 337 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHFDDVWAPAQSEKFRVKANFIDQLVVLTGGSSTIEPPVGYSKIEYDLNAGAGGDFIYLCYHEQTWQADRPKDAVTDIRIIFNKEPTPPGYTKLPQDLNKGAGGDDVFLCYKTEAFNTDTAINKVTVIGGNNADLNAPYGYLKVPGDLNRGAGGNFIYACTFVGK

SEQ ID NO: 338 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHFDDVWAPAQSEKFRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAFNTDTAINKVTVLGGNNADINAPYGYLKVPGDLNRGAGGNFIYACTFVGK

SEQ ID NO: 339 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAETKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANFIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADLNAPYGYLKVPGDLNRGAGGNFIYACTFVGK

SEQ ID NO: 340 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAFNTDTAINKVTVIGGNNADINAPFGYLKVPGDLNRGAGGNFIYACTFVGK

SEQ ID NO: 341 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHFDDVWAPAQSEKFRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADLNAPYGYLKVPGDLNRGAGGNFIYACTFVGK

SEQ ID NO: 342 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATFTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTLEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 343 - protein, 483 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPELVDVQQNDSATYTNVSGNTLSEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKFRVKANYIDQLVVITGGSSTLEPPVGYSKIEYDLNAGAGGDFIYLCYHEQTWQADRPKDAVTDIRIIFNKEPTPPGYTKLPQDLNKGAGGDDVFLCYKTEAYNTDTALNKVTVIGGNNADINAPYGYLKVPGDLNRGAGGNFIYACTFVGK

SEQ ID NO: 344 - protein, 483 aa, Artificial Sequence; identical to SEQ ID NO: 323
  IPD090 variant

SEQ ID NO: 345 - DNA, 1449 bp, Artificial Sequence
  IPD090 variant
atggaacacgtagacctgccaacgggtctggtaaaattttcctctaatcaccacctgcaactgctgcgtgatacggcagatctgagcgaatccgtactgcctggcgtcgaagccattggtctgggctataacccattcctgggttatgccggtgtcggcagcggcacggtgcaactgttcgactggaacaacgccaagaaaaaaaaagtgtctttcaaacctgaattcgtcgtacctgagatcgtcgacgtgcaacagaacgacagcgcatcctacaccaacatcagcggcaacacggtcaccgagtaccagcgcagcctggctgtcagcgtcgccatcgaaggcaaatacaacttcttcagcggctctctgtccacggattacgacgaaaattctctgcgcaacgcggaaaacgagttcactcgcattcagcaatctatcaacctgtggtctctgcgcctgccttctgtgaagtctctgcgcgacctgatgctgccacacatgcgcgaacaactggatgaactggacgtcaaaaacccgagcgccatcagccgctttttcgatcgtgttggcagccatttcctgaccggcatcgtaatgggtggtcgtgccatcctggccgcctctaccaacaagctgaaggtcaagcgtgactactctgtgtctgtgatcgccaaggcgagctacgaaggtctgaccggccagctgagcgcagaagcccgtaccaagtatggcgagtctatgagcagcttcactcagtactccagcacccaccaggaagtgcgcggcggcgacggtaccaaggcacatggtgtgttcgaaggcaaagcaggtttccaggcctgggtagacagcgtgggcacctctccggacttcgtcgatttcgtccctaccatccctatgctggaaatctggtccctgtgcaaaaccgactctcaggccgaggccatgaaacgtcatttcgataccgtctgggcgcgtgagcaatctgacaagtaccgtatcaaggctaactacatcgaccaactggtggtcatcaccggcgatagctctaccatcgaaccaccggccggctacaccaagatcccgtacgacctgaatgccggtgccaaaggtgacttcatctacctgtgctatcacgaacaagcctggtaccctgacaacactaaacctgctgtgacggctatcaagatcatttacgaccgtgagcctgtcccaactggctatatcaagctgcctcaggacctgaacaagggcgcgggcggtgctgatatctacctgtgctacaagctggagggttacaacaccgacaccgcaatcaacaagatcacggtcatcagcggcaacaatccggatatcaacgctccttatggttatgagaaggtccctggtgacctgaacaaaggtgctaaaggcaacttcatctatgcctgtaccttcgtaggcaag

SEQ ID NO: 346 - DNA, 1473 bp, Artificial Sequence
  IPD090 variant
atggaaaacatagacttgccacaaggacttgtaaacttttccacgcaacacctgcaacttattcgttttaaagcaggtttgaatgaaaccgtactacctggcgtcgaagccattggacttggctataacccattcatcagttatgccagtgtcaacagcggcgcggtgcaattgttcgactgggccacggccaagaaacgcgaagtgcctttcaaagccggctacttcgtacccgagatcgtcgacgtgcaacagaacgacagcgcaacctacaccaacgtcagcggcaacacgatcagcgagtaccagcgcagtctggctaccagcgtcgccatcgaaggccgttacaacttcttcagtggctcgctgtccacggatttcgacagtaattcactgcgcaacgcggaaaacgagttcactcgcattcagcaatcgatcaacctctggtcgttgcgcttgccttcggtgaagtcattgcgcgaactgatgctgccacacatgcgccaacaactagatgaattgaacgtcaacgacccgaaggccataagccgctatttcgatagagttggcagccatttccttaccggcatcgtaatgggtggacgggccatcctcgcctcctcgaccaacaagctcagggtcaagcgtgactactcggtgtcggtggtcgccaaggcgagctacgaagggcttaccggccagttgagcgcagaagccaaagccaagtatggcgagtcgatcagcagcttcactcagtactccaatacccaccaggaagtgcgcggcggcgacggtgccaaggcacatggggtgttcagcggcaaaaaagaagatttccaggcctgggtagacagtgtgagcgcctcgccggacttcgtcgatttcgtccccaccatccccatgcaggaaatctggaccctgtgcagcagcgaggcgcaggccgaggccatgcgcaagcattacgatgacgtctgggcgccggcgcaatcggaaaagtaccgggtcaaggctaactacatcgaccaactggtggtcatcaccggcggtagttcaaccatcgaaccaccggtcggctacagcaagatcgagtacgacctcaatgccggtgccggcggtgacttcatctacttgtgctatcacgaacaaacctggcaggccgacaggcctaaagatgctgtgacggatatcaggatcattttcaacaaggagcctaccccacctggctataccaagctgccccaggacctgaacaagggcgcgggcggtgatgatgtattcctctgctacaagaccgaggcttacaacaccgacaccgcaatcaacaaggtcacggtcatcggcggcaacaatgcggatatcaacgctccctatggttatctgaaggtccccggtgacctcaacagaggtgctggcggcaacttcatctatgcctgtaccttcgtaggcaagctcgagcaccaccaccaccaccac

SEQ ID NO: 347 - protein, 503 aa, Artificial Sequence
  IPD090 variant
MGSSHHHHHHSSGLVPRGSHMENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 348 - DNA, 1473 bp, Artificial Sequence; identical to SEQ ID NO: 346
  IPD090 variant

SEQ ID NO: 349 - protein, 491 aa, Artificial Sequence
  IPD090 variant
MENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGKLEHHHHHH

SEQ ID NO: 350 - DNA, 1500 bp, Artificial Sequence
  IPD090 variant
atgaaaagcctggaccatgtggcacaccagaacctgctgaatgaaccgacccatcataagagcaacaccaaagcggcgctgatgcgccaccaggaaaacctggtggaacgctatctgcctggtgttgaagtgatcggcgccggttacaacccgttcggtgtctacgctagcacggattccgtaactgtacagctgttcgactggcagtctgcgccgtctgaaccggttatcttcaacccggactacatcgcaccaaaagcggtgtctgtgcagcagaacgacgaagcccgttacactaacgtctccggtaagactatcaacacgtttcagaaaaacttcagcctgaaagtgacggtggctggttcttacaacctgttcagcggttctgtgagcaacgaattcagctcttctgaaactcgtaacgctgagaacgaattctcccgtatccagcagagcatccgtgtttggtccctgcgtctggcgtatactgacagcctgcgcgaatacctgaaagcggacgtacgtgactacatcgacagcattcaatccgatgcgcagatcgaaatcctgttcgatcgttacggctctcatttcctgaccggtgtagttatgggcggtgcagctatcatggcgagctccaccaacaaagtgcaggtggaccacacttatgaaaacgaaaccatcgccaaagcgtcttacgaagctctgaccggtcagatcagcgctgaaaccgctgcgaaataccgtcagtctatgagctctttctctcaaaactccgacatccacaagatcgttgttggtggcgatggtgttgctggtgctaaagtgtactctggtgataaagctgattttgatgcgtgggccgataccgtcggtaccagcccggattttgtagattttgtttcctccgtgccgatgctgggtatctgggagctgtgtaaagatgatgcccaggcaaagaaaatggaggactattacaacaacacctgggcgccacgcaagagcaaagaagcgcaaatctacgcggactacatcgatgcagtcgaagtgatccagtccaattccagcggtgttcgcccaccgagcggctacacgaaaatcgattacgatctgaacaaaggtgcaggcggcgactacatctacctgtgctaccataaagctcgctactctgcttactctgaaaacaaagattgcgtttctgacctgatcatcatcaaaggtaacggtgcgcgcgctccaagcggttacactaaaattgatgtggacctgaacgaagatgccggcggcaagtatctgtatctgtgttataaaaaacagtcttacgataacgttgaagcgattaaaggcctggctgtggtaggcggcgacaactctcacactccggctccgtacggctaccgccgtattgacaccgatgtaaacgagggtgctggtggcgaatatatttatatttgctattccaaaggcgccggatccctcgagcaccaccaccaccaccac

SEQ ID NO: 351 - protein, 500 aa, Artificial Sequence
  IPD090 variant
MKSLDHVAHQNLLNEPTHHKSNTKAALMRHQENLVERYLPGVEVIGAGYNPFGVYASTDSVTVQLFDWQSAPSEPVIFNPDYIAPKAVSVQQNDEARYTNVSGKTINTFQKNFSLKVTVAGSYNLFSGSVSNEFSSSETRNAENEFSRIQQSIRVWSLRLAYTDSLREYLKADVRDYIDSIQSDAQIEILFDRYGSHFLTGVVMGGAAIMASSTNKVQVDHTYENETIAKASYEALTGQISAETAAKYRQSMSSFSQNSDIHKIVVGGDGVAGAKVYSGDKADFDAWADTVGTSPDFVDFVSSVPMLGIWELCKDDAQAKKMEDYYNNTWAPRKSKEAQIYADYIDAVEVIQSNSSGVRPPSGYTKIDYDLNKGAGGDYIYLCYHKARYSAYSENKDCVSDLIIIKGNGARAPSGYTKIDVDLNEDAGGKYLYLCYKKQSYDNVEAIKGLAVVGGDNSHTPAPYGYRRIDTDVNEGAGGEYIYICYSKGAGSLEHHHHHH

SEQ ID NO: 352 - DNA, 1509 bp, Artificial Sequence
  IPD090 variant
atgggcagcagccatcatcatcatcatcacagcagcggcctggtgccgcgcggcagccatatggaacacgtcgacctgccgacgggactcgtcaaattttccagcaatcaccatctgcaattgctgcgcgacaccgccgacctcagtgaatcagtgcttccgggcgtagaggccattggcttgggatacaacccattcctcggctacgccggtgtgggaagcggcaccgtccagcttttcgactggaacaacgcaaaaaagaaaaaagtgtcattcaaacccgagttcgtcgtgccggagatcgtcgacgtccagcagaatgacagcgccagctacaccaacatcagtggcaacaccgtcaccgagtatcaacgcagcctggccgtcagcgtggccatcgaaggcaaatacaacttcttcagtggttcgctttcaaccgactacgacgaaaactcgctgcgtaatgccgagaacgagttcacccgtatccagcaatcgatcaacctctggtcgctgcgcctgccttcggtcaaatcactgcgcgacctgatgctgccgcacatgcgtgagcaactggatgagctggacgtgaaaaacccgagtgccatcagccggttcttcgaccgggtgggcagccacttcctcaccggcatcgtgatgggcggccgagccatactcgccgcctcgaccaacaaactgaaggtcaagcgcgactactccgtgtcggtcatcgccaaggcgagctacgaaggcttgaccggccagctgagcgccgaggccaggaccaagtacggcgaatccatgagcagtttcacccagtactccagcacccaccaggaagtccgtggcggcgatggcaccaaggcccatggtgtgttcgagggcaaggccgggttccaggcctgggtcgacagcgtggggacctcgcccgatttcgtcgacttcgtgcccaccatcccgatgctggagatctggagcctgtgcaagaccgattcacaggctgaagccatgaagcgccatttcgacacggtctgggcccgcgaacaatcggacaagtaccggataaaggcgaactacatcgatcagctggtggtaatcaccggtgacagttcgaccatcgaacctccggctggctataccaagattccctacgacctcaatgccggggccaagggcgacttcatctatttgtgctaccacgaacaagcgtggtatcccgacaacaccaaacctgccgtcaccgcgatcaagatcatctacgaccgggaaccggtacccaccgggtatatcaagctgccgcaagacctcaacaaaggcgcaggtggcgcggacatctacctttgctacaagctcgagggctacaacaccgataccgcgatcaacaagatcaccgtgatcagcgggaacaaccccgacattaacgccccctatggctatgagaaagtgccgggcgacctgaacaagggcgcaaaaggcaacttcatctatgcctgcactttcgtcggcaag

SEQ ID NO: 353 - protein, 503 aa, Artificial Sequence
  IPD090 variant
MGSSHHHHHHSSGLVPRGSHMEHVDLPTGLVKFSSNHHLQLLRDTADLSESVLPGVEAIGLGYNPFLGYAGVGSGTVQLFDWNNAKKKKVSFKPEFVVPEIVDVQQNDSASYTNISGNTVTEYQRSLAVSVAIEGKYNFFSGSLSTDYDENSLRNAENEFTRIQQSINLWSLRLPSVKSLRDLMLPHMREQLDELDVKNPSAISRFFDRVGSHFLTGIVMGGRAILAASTNKLKVKRDYSVSVIAKASYEGLTGQLSAEARTKYGESMSSFTQYSSTHQEVRGGDGTKAHGVFEGKAGFQAWVDSVGTSPDFVDFVPTIPMLEIWSLCKTDSQAEAMKRHFDTVWAREQSDKYRIKANYIDQLVVITGDSSTIEPPAGYTKIPYDLNAGAKGDFIYLCYHEQAWYPDNTKPAVTAIKIIYDREPVPTGYIKLPQDLNKGAGGADIYLCYKLEGYNTDTAINKITVISGNNPDINAPYGYEKVPGDLNKGAKGNFIYACTFVGK

SEQ ID NO: 354 - DNA, 33 bp, Artificial Sequence
  gene isolation primer
cataaggaaatccatatggaaaacatagacttg

SEQ ID NO: 355 - DNA, 28 bp, Artificial Sequence
  gene isolation primer
attgggcgcagctcgagctacttgccta

SEQ ID NO: 356 - DNA, 27 bp, Artificial Sequence
  gene isolation primer
gcgcagcagctcgagcttgcctacgaa

SEQ ID NO: 357 - DNA, 37 bp, Artificial Sequence
  gene isolation primer
gcaacttattcgtcatatggcaggtttgaatgaaacc

SEQ ID NO: 358 - DNA, 28 bp, Artificial Sequence
  gene isolation primer
atagggacatccatatggaacacgtcga

SEQ ID NO: 359 - DNA, 26 bp, Artificial Sequence
  gene isolation primer
aagccagggtggatccttacttgccg

SEQ ID NO: 360 - DNA, 57 bp, Artificial Sequence
  mutagenesis primer
  misc_feature (22)..(22): m = a or c
  misc_feature (25)..(25): r = a or g
  misc_feature (39)..(39): r = a or g
gaaggagatatacatatggaamacrtagacttgccacarggacttgtaaacttttcc

SEQ ID NO: 361 - DNA, 57 bp, Artificial Sequence
  mutagenesis primer
  misc_feature (22)..(22): m = a or c
  misc_feature (25)..(25): r = a or g
  misc_feature (39)..(39): r = a or g
gaaggagatatacatatggaamacrtcgacctgccgacrggactcgtcaaattttcc

SEQ ID NO: 362 - DNA, 53 bp, Artificial Sequence
  mutagenesis primer
  misc_feature (5)..(5): r = a or g
  misc_feature (8)..(8): s = c or g
  misc_feature (23)..(23): s = c or g
  misc_feature (26)..(26): r = a or g
  misc_feature (32)..(32): y = c or t
  misc_feature (41)..(41): m = a or c
  misc_feature (43)..(43): s = c or g
tcgtrccsgagatcgtcgacgtscarcagaaygacagcgcmasctacaccaac

SEQ ID NO: 363 - DNA, 45 bp, Artificial Sequence
  mutagenesis primer
  misc_feature (11)..(11): s = c or g
  misc_feature (13)..(13): k = g or t
  misc_feature (22)..(22): r = a or g
  misc_feature (28)..(28): y = c or t
  misc_feature (31)..(31): s = c or g
gttggtgtagstkgcgctgtcrttctgytgsacgtcgacgatctc

SEQ ID NO: 364 - DNA, 43 bp, Artificial Sequence
  mutagenesis primer
  misc_feature (13)..(13): y = c or t
  misc_feature (16)..(16): y = c or t
  misc_feature (19)..(19): y = c or t
aacgagttccacycgyatycagcaatcgatcaacctctggtcg

SEQ ID NO: 365 - DNA, 41 bp, Artificial Sequence
  mutagenesis primer
  misc_feature (11)..(11): r = a or g
  misc_feature (17)..(17): r = a or g
accgaaggcargcgcarcgaccagaggttgatcgattgctg

SEQ ID NO: 366 - DNA, 49 bp, Artificial Sequence
  mutagenesis primer
  misc_feature (12)..(12): r = a or g
  misc_feature (18)..(18): y = c or t
  misc_feature (21)..(21): m = a or c
  misc_feature (24)..(24): r = a or g
  misc_feature (30)..(30): m = a or c
  misc_feature (37)..(37): k = g or t
accggcatcgtratgggyggmcgrgccatmctcgcckcctcggaccaac

SEQ ID NO: 367 - DNA, 49 bp, Artificial Sequence
  mutagenesis primer
  misc_feature (13)..(13): m = a or c
  misc_feature (20)..(20): k = g or t
  misc_feature (26)..(26): y = c or t
  misc_feature (29)..(29): k = g or t
  misc_feature (32)..(32): r = a or g
  misc_feature (38)..(38): y = c or t
gttggtccgaggmggcgagkatggcycgkccrcccatyacgatgccggt

SEQ ID NO: 368 - DNA, 65 bp, Artificial Sequence
  mutagenesis primer
  misc_feature (15)..(15): m = a or c
  misc_feature (21)..(21): y = c or t
  misc_feature (25)..(25): r = a or g
  misc_feature (28)..(28): r = a or g
  misc_feature (36)..(36): s = c or g
  misc_feature (39)..(39): y = c or t
  misc_feature (48)..(48): y = c or t
  misc_feature (54)..(54): y = c or t
ttccaggcctgggtmgacagygtgrgcrcctcgccsgayttcgtcgayttcgtycccaccatccc

SEQ ID NO: 369 - DNA, 65 bp, Artificial Sequence
  mutagenesis primer
  misc_feature (12)..(12): r = a or g
  misc_feature (18)..(18): r = a or g
  misc_feature (27)..(27): r = a or g
  misc_feature (30)..(30): s = c or g
  misc_feature (38)..(38): y = c or t
  misc_feature (41)..(41): y = c or t
  misc_feature (45)..(45): r = a or g
  misc_feature (51)..(51): k = g or t
gggatggtgggracgaartcgacgaartcsggcgaggygcycacrctgtckacccaggcctggaa

SEQ ID NO: 370 - DNA, 17 bp, Artificial Sequence
  mutagenesis primer
tacgacctcaatgccgg

SEQ ID NO: 371 - DNA, 17 bp, Artificial Sequence
  mutagenesis primer
ccggcattgaggtcgta

SEQ ID NO: 372 - DNA, 27 bp, Artificial Sequence
  mutagenesis primer
  misc_feature (12)..(12): y = c or t
  misc_feature (18)..(18): r = a or g
tacaacaccgayaccgcratcaacaag

SEQ ID NO: 373 - DNA, 27 bp, Artificial Sequence
  mutagenesis primer
  misc_feature (10)..(10): y = c or t
  misc_feature (16)..(16): r = c or t
cttgttgatygcggtrtcggtgttgta

SEQ ID NO: 374 - DNA, 59 bp, Artificial Sequence
  mutagenesis primer
ctcagtggtggtggtggtggtgctcgagctacttgcctacgaaggtacaggcatagatg

SEQ ID NO: 375 - DNA, 59 bp, Artificial Sequence
  mutagenesis primer
ctcagtggtggtggtggtggtgctcgagttacttgccgacgaaagtgcaggcatagatg

SEQ ID NO: 376 - protein, 5 aa, Artificial Sequence
  peptide linker
EEKKN

SEQ ID NO: 377 - protein, 484 aa, Artificial Sequence
  IPD090 variant
MAENIDLPQGLVNFSTQHLQLIRFKAGLNETVLPGVEAIGLGYNPFISYASVNSGAVQLFDWATAKKREVPFKAGYFVPEIVDVQQNDSATYTNVSGNTISEYQRSLATSVAIEGRYNFFSGSLSTDFDSNSLRNAENEFTRIQQSINLWSLRLPSVKSLRELMLPHMRQQLDELNVNDPKAISRYFDRVGSHFLTGIVMGGRAILASSTNKLRVKRDYSVSVVAKASYEGLTGQLSAEAKAKYGESISSFTQYSNTHQEVRGGDGAKAHGVFSGKKEDFQAWVDSVSASPDFVDFVPTIPMQEIWTLCSSEAQAEAMRKHYDDVWAPAQSEKYRVKANYIDQLVVITGGSSTIEPPVGYSKIEYDLNAGAGGDFIYLCYHEQTWQADRPKDAVTDIRIIFNKEPTPPGYTKLPQDLNKGAGGDDVFLCYKTEAYNTDTAINKVTVIGGNNADINAPYGYLKVPGDLNRGAGGNFIYACTFVGK

SEQ ID NO: 378 - DNA, 1449 bp, Unknown
  Identified from a pool of bacterial strains
atgcagatcgtcgacttaccgaaaggacgcgtcaacttctccgctaatcaccacctgcagttgttacgcttcaaggcaggcctaagcgaagatgtgcttccgggcgtagaagccattggactgagctacaacccgttcctgagctacgcaagtgtggacagcggagccgtccaactcttcgactggtacagtgcgaagaagaaaaatgtgtcgttcaagccgggttttgtcgtccctgaaatcgtcgacgttcagcagaatgatagtgcaagctacacaaacatcagtggcagcactatttccgagtaccagaaaaaccttgcaaccagcgtggccattgaagggaagtacaacttctttagcggatcgctctccaccgactacgatgaaaactcgttgcgcaatgccgaaagcgagtttagccgtatccagcagtcgattaatctctggtcgctgcgactgccatcggtgaagttactacgtgacctcatgctgccgcacatgcgggagcagttggacgagctggatgtaacgaagccggaggccgtcagcaagtattttgatgatgtgggcagccactttctgaccggcatcgtgatgggaggacgggccatactcgcctcatcgacgaacaagctgacggtcaaacgcgactactcgatttcggtcgtcgccaaagccagctacgaaggtttgaccggtcagttgagtgcagaagccaaggccaagtacggcgaatccatcagcagcttcacccagaactccaatacccaccaggaagtccggggtggcgacggcaccaaagcgcatggcgtgttcaacggccaggaaggcttccagacatgggtcgacagcgttggtgcttcgcccgacttcatagacttcgtgccgacaattccgatgcaggaaatctggagcttgtgcaaaaccgacgaacaagctgacgcgatgaaattgcattacgaaacgatatgggcgcccgcgcaatcggagaaataccggctaaagccgaactacattgaccaactggtggtgattaccggcggtagttcgaccatcgaaccgcctgctggctatgccaaggttccctacgacctcaatactggtgccggcggcgatttcatctacctttgctaccacgagcaagcgtgggagccggacaaccttaaaccggccgtgaccgcgatccagatcatttataaccaggaggtaacaccggaaggctatatcaaattgcctcaagacctgaacaaaggcgcaggcggtgatgatgtgtatctctgctacaaatccgacacctacgacaccaataacgcggtcaacaaagtcaccgttatcggcggcggcaacgccgatatcaatgcgccctatggttacgacaaggtgccgggagatttgaacagaggcgccggtggcgaattcgtctatgtttgcacgtttgtaggcaga

SEQ ID NO: 379 - protein, 483 aa, Unknown
  Identified from a pool of bacterial strains
MQIVDLPKGRVNFSANHHLQLLRFKAGLSEDVLPGVEAIGLSYNPFLSYASVDSGAVQLFDWYSAKKKNVSFKPGFVVPEIVDVQQNDSASYTNISGSTISEYQKNLATSVAIEGKYNFFSGSLSTDYDENSLRNAESEFSRIQQSINLWSLRLPSVKLLRDLMLPHMREQLDELDVTKPEAVSKYFDDVGSHFLTGIVMGGRAILASSTNKLTVKRDYSISVVAKASYEGLTGQLSAEAKAKYGESISSFTQNSNTHQEVRGGDGTKAHGVFNGQEGFQTWVDSVGASPDFIDFVPTIPMQEIWSLCKTDEQADAMKLHYETIWAPAQSEKYRLKPNYIDQLVVITGGSSTIEPPAGYAKVPYDLNTGAGGDFIYLCYHEQAWEPDNLKPAVTAIQIIYNQEVTPEGYIKLPQDLNKGAGGDDVYLCYKSDTYDTNNAVNKVTVIGGGNADINAPYGYDKVPGDLNRGAGGEFVYVCTFVGR

SEQ ID NO: 380 - DNA, 1512 bp, Pseudomonas monteilii
atgctggttccttgctcgtttgctgagcggttatatctgcccataacacataaggaaatcatcatggaaaacatcgacttgccgcaaggacttgtgcacttttccacccaacacctgcaacttattcgttttaaagcaggtttggatgaaaaagtactgccgggcgtcgaagctatcggacttggctataacccattcatcagttatgccagtgtcaacagcggcgcggtgcagttgttcgattggaccacggcgaaaaaacgcgaagtatcattcaagccaggctacttcgttccggagatcgtcgacgtccagcagaacgacagcgccacctataccaacgtcaccggcagcaccattaccgagtaccagcgcagcctggccaccagcgtggccatcgaggggcgctacaacttcttcagcggctcgctctccaccgacttcgacagcaactcgctgcgcaacgcggaaaacgaattcagccgcatccagcagtcgatcaacctctggtcgctgcgcctgccttcggtcacgtcgctgcgcgaattgatgctgccatacatgcgccagcaactcgacgagctcaacgtcaatgatcccaaggctatcagccgctatttcgacagggtcggcagccatttcctgaccggtatcgtgatgggcggacgggccatcctcgcctcctcgaccaacaagctgcgggtcaagcgcgactactcggtggcggtagtggccaaggccagctacgaagggctcaccggccagctgagcgccgaagccaaggccaagtacggcgagtcgatcagcagcttcacccagtactccaatacccaccaggaagtccgcggcggtgacggcaccaaggcacaggccgtgttcagtggcaaggaagggttccaggcctgggtcgacagcgtggggacctcgccggacttcgttgatttcgtcccgaccattcccatgcaggaaatctggagcctgtgcaagaccgaggcgcaagccgaagccatgcgcaagcactacgatgacgtttgggcgccggcacagtcggaaaaataccggatcaaggcgaactacatcgaccagctggtggtgatcaccggcggcagctcgaccatcgaacctccggtgggctacagcaaggtggagtacgacctcaacgctggcgccggtggcgacttcatctacctgtgctatcacgagcaagcctggcaggccgaccagccgaagagcgccgtgaccgacatcaggatcatctacaacaaggagccgaccccggcgggctacatcaagctgccccaggacctgaacaagggcgccggcggcgatgatgtgttcctctgctacaagaccgaggcctacaacaccgacaccgcaatcaacaaggtgacggtcatcggtggtggcaatgccgatatcaacgcaccctacggctacaagaagatacccggcgacctcaaccgcggggccggcggcaacttcatctacgcctgcaccttcgtcggcaagtag

SEQ ID NO: 381 - DNA, 1413 bp, Clavibacter michiganensis
atgtctgacttcttcgtgactgaaaccgacactccacgcattcttccaggggtcagcttgaccggctccacgtacgacgtgttcggagacgatgccaccaacgactccgccatattccagatcttcgattggagcaaggcggaatggggaaccaccgagatcaacggaaccgagtacaggatcccgaagctgatgaacgctgaaggcgtcgcggggagcgaatacgtctccatctacggcaacaccgtcgaggaataccagcagagcctcgccgcgtccgtggcggtctcgggatccaacatgttcttcagcggctcgttggagacgcagttcggctccagctcgatgcggaggtcggagaacgcgttctcccgcgtagagcaggtcgtcaagctgtggtcgatcggcctgcctccgagcaagaagctgcgagagctcctcagcggcagcttcctggaagccctcgacgggctccccgcggcagcatcgacgagcgaagagcaggcggagtacaagggcttcctcgacacgtggggcgcgttctacctctccgggatgctgatcggcggcaagaccttgttcacctcctccgtgaacaagctcaccgtggacaggacgctctcgatctcggtcacagcggacttgtcatacaagtcggtgacaggccagatcagcaacgaggacaagatcaagtacgcctcccagctctcgcagttcgcttcgagctccaacacggtaaagaatgcattcggtgggaacccggctctcgcctcacgcgtattcgacggccgcgtgcagtacgacgagtggtcggcatccgtcgcccagaaccccgtcatcgtccgcttcgacggaacccggcccctgaccggcgtgtggactctctgctcgacgccggagcgggggaagatcctggagtcctacttcgacgacaagtgggcacccgcgcgttcgctcgaactatcccacttccccgacgtggtcgatgacctcaccgtcgtggtgggcaacgacgatcagccccctgtaccggacggctacacgaaggacgactacgacctcaacaggcacgcaggcggaaagttcatctatctctgctggcacaaggtgccggtctccggattgaggaagccgaagcgcgtgcttcaagccatgcaggtgatctacaacggcgacaaggtgccggacgggtactcgaagatcaacgtcgatctcaaccaaggcgcaggcggtgatgacgtgttcctctgcatgaagcagggcgaatacggcacggacgagaacattctcgacgtgcgggtgatcggtggcaacgacagcttcgtgcccgcgccttacggctacaagacccttcccggggatctgaacaagggggccggcggcgactacgtctacatcgcctacgccaattga

SEQ ID NO: 382 - DNA, 1470 bp, Serratia proteamaculans
atgaaaattgaatcatccaaggttgaaggtttgtttagctcatcttttactcgtgttaatgctgtccctctcccgagcgatactttacccggcgtaggtattattggttgtggctacaatccatttttagcctatgcagatgcttctgctgtcctgcatcctattctcgactggtcaaaatctcagtttaacgaaattactatgaacggtcagcaatatcaattacctgatgtgcttcaggcggtatggctcagtaaccagtcttacgcatcggtaacggggaaatcgctccaaagttatttaactgaattggctaacagtattaaagtaagtggtaactatggcttttttagtgcctcagccacaaatgaatttagcgacagttcattgagaaagtcagaaaatgagtttagtcgatgtcagcagtcatttgatttgtggtcaattagtatcccagccgatattgcaaggttgcaaaactatgtttcagatgattttataaaactgattaatgcaataaatccagaaagtaaagattcaatagccactgtattcaacgtttatggcagccatgttctaatgagtggtgttatgggcgggaaagctcacgtatccgcctcagcaaacaagttaacactcacccaaaaatttgagatgagtacgattgttcaggctaaatacgaacaactaacatcacaacttagcgtcgaagacaaacttaagtattcagaagccttcgatagtttcagcgaaagcggtagttacacatatgatattctaggcggtagcccttctttaggggcgcttgtttttaaaaataactcgcaaggtagtagtgacgataatttaaaaaattggatacagtctatttccagtatgccggtgttgaccaagttcatagaccaaacctcgttaatgcctgtatggctattgtgtgaagacaagacaaaagccgatgcattaaaaaaatattacgataatacatggtcaaaatcgcagatggccgttgccagtctcagagcaaactacatcgacgagctgacatttgtcctgggtgacaactcagatatccctgctccagtcggatacactaaagttccgattgatcttaattctgatgctgggggtaaatatgtctatctttgctatcatgaagcgcagttcacgccagtaaatggcaaacagccgattgttgatatccaagtgctctatggtagccagatgccagcgcctggatatataaaaattgatgttgatttgaatagcggtgctggcggggaatttgtctacctttcatacaaaaagggagaaccaacgtcgtccgatgtaattaataaaatcaccgctgtatatggaaaaaatgagtacgtcccaaccccatatggatataaacaaattagcggtgaccttaatgctggagcaggcggtgactttgtttacctctgtacttaccaaggtggtacagaataa

SEQ ID NO: 383 - DNA, 1461 bp, Marinomonas sp.
atgactttattttttaaatctaaaaaccataaaaagggaaaatttatgaacaacagagcttttcatgaaaagtttcaagtagctgagttaaattcggacgccaactatctttcaggtgttagctctttaggatgtggctatgatgtctttggagaatatgcaactccgatatcaattacttttccattatttgattggacaaaagtacctaccagagctgtaactttttataagggaaaagtgatacctaacatagtaagtgccgtacaacttgaaacttccaattacaaagaaatatcaggcagctcaattgaagagtacataaaaaacttaaatacttatacaaaacttgaaggaagttacagcttttacagtggctccgtttctgtcggctataatgcaagtgagtatagaaatgctaaaaacgagttttcacttattcagcaagacattgctaaatgggctttaaagtttactcctgaaacagctcttaactacatcaaagatgacgtaaaaaatgatatagctgatatggacccaattcagttatttaaaagatatggtacacacttcctatcagcgattgtaattggcggcaaatcaatgatgacttccgcaaccaatcaagtagattatcagtccgaatatggcattgatctaactgcaaaactagcttatgagagtcttactttccagatcagcgcagaaaataaaactaaatactctcaagaaatatctacttttgaaagccggtctaatactgaagttagaacgtatggaggcagcgcagaaaaaggtggtactaacattttgaaggaaggaggctttcaggaatggcaagatagcgttggagacaatcctacatttgtagattttgacaatgataatgcgcttaccccaatttgggaactttgtgaagatcaaaagagaaaagaagctttaattcacgcttatgccacctttgcgaaagggaaaacgtctgagtgcttaaatgtattcagtgctaattctattactgaattaagagtaatatcaggcgactcaagcgttatacagccacctacagggtatattaaggacgactttgatctaaataaaggtgcaggaggaaagttcatttatgtctgttataaagaagattcaactttagatattaaagctgaaaagctggatgtaataactgatataacaacaatttcaggtgacagccccgatattcaagcacctgatggttatataaaaataggtcaagacttgaatgagggagcaagaggtaaatatatttacctatgctataaaaaaggcgagtattcagaaacagactctatcaaggacataatggtgataggctcaagtcagccacaaatttaccctccaataggatttgaaagaataaaccaggacctaaatcaaggagctggaggactttacatctacatgtgttattcaagaacattgtag

SEQ ID NO: 384 - protein, 503 aa, Pseudomonas monteilii
MLVPCSFAERLYLPITHKEIIMENIDLPQGLVHFSTQHLQLIRFKAGLDEKVLPGVEAIGLGYNPFISYASVNSGAVQLFDWTTAKKREVSFKPGYFVPEIVDVQQNDSATYTNVTGSTITEYQRSLATSVAIEGRYNFFSGSLSTDFDSNSLRNAENEFSRIQQSINLWSLRLPSVTSLRELMLPYMRQQLDELNVNDPKAISRYFDRVGSHFLTGIVMGGRAILASSTNKLRVKRDYSVAVVAKASYEGLTGQLSAEAKAKYGESISSFTQYSNTHQEVRGGDGTKAQAVFSGKEGFQAWVDSVGTSPDFVDFVPTIPMQEIWSLCKTEAQAEAMRKHYDDVWAPAQSEKYRIKANYIDQLVVITGGSSTIEPPVGYSKVEYDLNAGAGGDFIYLCYHEQAWQADQPKSAVTDIRIIYNKEPTPAGYIKLPQDLNKGAGGDDVFLCYKTEAYNTDTAINKVTVIGGGNADINAPYGYKKIPGDLNRGAGGNFIYACTFVGK

SEQ ID NO: 385 - protein, 470 aa, Clavibacter michiganensis
MSDFFVTETDTPRILPGVSLTGSTYDVFGDDATNDSAIFQIFDWSKAEWGTTEINGTEYRIPKLMNAEGVAGSEYVSIYGNTVEEYQQSLAASVAVSGSNMFFSGSLETQFGSSSMRRSENAFSRVEQVVKLWSIGLPPSKKLRELLSGSFLEALDGLPAAASTSEEQAEYKGFLDTWGAFYLSGMLIGGKTLFTSSVNKLTVDRTLSISVTADLSYKSVTGQISNEDKIKYASQLSQFASSSNTVKNAFGGNPALASRVFDGRVQYDEWSASVAQNPVIVRFDGTRPLTGVWTLCSTPERGKILESYFDDKWAPARSLELSHFPDVVDDLTVVVGNDDQPPVPDGYTKDDYDLNRHAGGKFIYLCWHKVPVSGLRKPKRVLQAMQVIYNGDKVPDGYSKINVDLNQGAGGDDVFLCMKQGEYGTDENILDVRVIGGNDSFVPAPYGYKTLPGDLNKGAGGDYVYIAYAN

SEQ ID NO: 386 - protein, 489 aa, Serratia proteamaculans
MKIESSKVEGLFSSSFTRVNAVPLPSDTLPGVGIIGCGYNPFLAYADASAVLHPILDWSKSQFNEITMNGQQYQLPDVLQAVWLSNQSYASVTGKSLQSYLTELANSIKVSGNYGFFSASATNEFSDSSLRKSENEFSRCQQSFDLWSISIPADIARLQNYVSDDFIKLINAINPESKDSIATVFNVYGSHVLMSGVMGGKAHVSASANKLTLTQKFEMSTIVQAKYEQLTSQLSVEDKLKYSEAFDSFSESGSYTYDILGGSPSLGALVFKNNSQGSSDDNLKNWIQSISSMPVLTKFIDQTSLMPVWLLCEDKTKADALKKYYDNTWSKSQMAVASLRANYIDELTFVLGDNSDIPAPVGYTKVPIDLNSDAGGKYVYLCYHEAQFTPVNGKQPIVDIQVLYGSQMPAPGYIKIDVDLNSGAGGEFVYLSYKKGEPTSSDVINKITAVYGKNEYVPTPYGYKQISGDLNAGAGGDFVYLCTYQGGTE

SEQ ID NO: 387 - protein, 486 aa, Marinomonas sp
MTLFFKSKNHKKGKFMNNRAFHEKFQVAELNSDANYLSGVSSLGCGYDVFGEYATPISITFPLFDWTKVPTRAVTFYKGKVIPNIVSAVQLETSNYKEISGSSIEEYIKNLNTYTKLEGSYSFYSGSVSVGYNASEYRNAKNEFSLIQQDIAKWALKFTPETALNYIKDDVKNDIADMDPIQLFKRYGTHFLSAIVIGGKSMMTSATNQVDYQSEYGIDLTAKLAYESLTFQISAENKTKYSQEISTFESRSNTEVRTYGGSAEKGGTNILKEGGFQEWQDSVGDNPTFVDFDNDNALTPIWELCEDQKRKEALIHAYATFAKGKTSECLNVFSANSITELRVISGDSSVIQPPTGYIKDDFDLNKGAGGKFIYVCYKEDSTLDIKAEKLDVITDITTISGDSPDIQAPDGYIKIGQDLNEGARGKYIYLCYKKGEYSETDSIKDIMVIGSSQPQIYPPIGFERINQDLNQGAGGLYIYMCYSRTL

SEQ ID NO: 388 - protein, 488 aa, Serratia plymuthica
MKFESLKVENLFSSSLTRINAIPLPNDALPGVGIIGCGYNPFLAYADSSAVLHPVLDWSKSQFHTVTMNGQTYQLPEILNAVWLSNQTYSSVSGKSLQSYLTELSNSIKVSGNYGFFSASATNEFTDSSLRKSENEFSRCQQSFDLWSISAPADIARLQNYISDDFKKLISSIDPNNQQTLATIFNVYGSHILMSGVMGGKAHVSASANKLTLTQKFEMSTIVQAKYEQLTSQLSAEDKLKYSEAFESFSESGSYTYDILGGSPSLGALVFKVNNQDSDDNLRKWIDSISTMPVLTKFIDQTSLLPVWTLCEDQVKADALKNYYNNTWSQLQMAVARLRANYIDEVTFVLGDNSDIPAPAGYTKVPVDLNSGAGGKFIYLCYHEAQFTPVNSKQAIVGLQVLYGKQEPAPDYSRINIDLNSGANGDDVYLSYKKGDATSKEVINKITAVYGKDQYVPTPYGYKQIPGDLNSGAGGDFVYFCTYQGGTE

That which is claimed is:

1. A DNA construct comprising a recombinant polynucleotide operably linked to a heterologous regulatory element, wherein the recombinant polynucleotide encodes an insecticidal polypeptide having at least 80% sequence identity to the amino acid sequence of SEQ ID NO: 2.

2. A transgenic plant comprising the DNA construct of claim 1.

3. A method of inhibiting growth or killing an insect pest or pest population, comprising contacting the insect pest with an insecticidal polypeptide having at least 80% sequence identity to the amino acid sequence of SEQ ID NO: 2, wherein the insecticidal polypeptide is joined to a heterologous signal sequence or a transit sequence.

4. The method of claim 3, wherein the insect pest or pest population is resistant to at least one Cry insecticidal protein.

5. A transformed prokaryotic cell comprising the DNA construct of claim 1.

* * * * *